United States Patent 8,207,316 (HCMV-RELATED NUCLEIC ACIDS AND MICRORNA) - sequence listing, part 3

SEQ ID NO: 44418 - DNA, 24 bp, Homo sapiens
agaaagatgcaggacagcatttca

SEQ ID NO: 44419 - DNA, 17 bp, Homo sapiens
caacttgtatatttggc

SEQ ID NO: 44420 - DNA, 16 bp, Homo sapiens
cagcccctcatggcca

SEQ ID NO: 44421 - DNA, 24 bp, Homo sapiens
cagccctacccattgatcatttca

SEQ ID NO: 44422 - DNA, 22 bp, Homo sapiens
ttgaatgtttttgctgttttta

SEQ ID NO: 44423 - DNA, 17 bp, Homo sapiens
gcaacctcagccaatga

SEQ ID NO: 44424 - DNA, 16 bp, Homo sapiens
tcctttgaacatggga

SEQ ID NO: 44425 - DNA, 18 bp, Homo sapiens
ttctgatgatggaatttc

SEQ ID NO: 44426 - DNA, 27 bp, Homo sapiens
gcagtccctcactttgaaaccttcgca

SEQ ID NO: 44427 - DNA, 20 bp, Homo sapiens
atatccatgaatgcaatttg

SEQ ID NO: 44428 - DNA, 18 bp, Homo sapiens
ctgtagttttaattcctc

SEQ ID NO: 44429 - DNA, 19 bp, Homo sapiens
ctttgccatagttcagcta

SEQ ID NO: 44430 - DNA, 20 bp, Homo sapiens
atcgacaaaagaaccattga

SEQ ID NO: 44431 - DNA, 16 bp, Homo sapiens
ggcggtggcatcgaca

SEQ ID NO: 44432 - DNA, 18 bp, Homo sapiens
ttggctacaaccctgaca

SEQ ID NO: 44433 - DNA, 17 bp, Homo sapiens
ctctccttctctctctg

SEQ ID NO: 44434 - DNA, 24 bp, Homo sapiens
gattggtatggtaatttaaagcaa

SEQ ID NO: 44435 - DNA, 17 bp, Homo sapiens
tcctccgatggctgtga

SEQ ID NO: 44436 - DNA, 24 bp, Homo sapiens
agtgggaaatttcagattactttt

SEQ ID NO: 44437 - DNA, 18 bp, Homo sapiens
tgcttcaagtaatacttc

SEQ ID NO: 44438 - DNA, 20 bp, Homo sapiens
tggtaatcaatgcatggcca

SEQ ID NO: 44439 - DNA, 24 bp, Homo sapiens
tttagcctttctcagtttattttt

SEQ ID NO: 44440 - DNA, 18 bp, Homo sapiens
aaagggtgatccagacat

SEQ ID NO: 44441 - DNA, 19 bp, Homo sapiens
acatttcccccaaaacaaa

SEQ ID NO: 44442 - DNA, 18 bp, Homo sapiens
agagcacattaagtctga

SEQ ID NO: 44443 - DNA, 18 bp, Homo sapiens
atttcccccaaaacaaaa

SEQ ID NO: 44444 - DNA, 21 bp, Homo sapiens
caagaaatcctcaccagcagt

SEQ ID NO: 44445 - DNA, 18 bp, Homo sapiens
tcaccgacagtaccatca

SEQ ID NO: 44446 - DNA, 17 bp, Homo sapiens
ttttgtacaaaatagtc

SEQ ID NO: 44447 - DNA, 18 bp, Homo sapiens
cacagacagacaataagc

SEQ ID NO: 44448 - DNA, 19 bp, Homo sapiens
ctgttgaaggtgttcatgg

SEQ ID NO: 44449 - DNA, 20 bp, Homo sapiens
gggtttaacagtttttgtta

SEQ ID NO: 44450 - DNA, 19 bp, Homo sapiens
tagaaattgaattagcata

SEQ ID NO: 44451 - DNA, 21 bp, Homo sapiens
tctgagcagtcttgtaatatt

SEQ ID NO: 44452 - DNA, 18 bp, Homo sapiens
aagacctcaatcatgtca

SEQ ID NO: 44453 - DNA, 20 bp, Homo sapiens
gagagataaacaagcataca

SEQ ID NO: 44454 - DNA, 21 bp, Homo sapiens
caaagttactttgactgcatt

SEQ ID NO: 44455 - DNA, 21 bp, Homo sapiens
cctctccccgacctcctccca

SEQ ID NO: 44456 - DNA, 17 bp, Homo sapiens
ctggctttccctttcca

SEQ ID NO: 44457 - DNA, 23 bp, Homo sapiens
gtcttgtcgaatcgctgcagcag

SEQ ID NO: 44458 - DNA, 19 bp, Homo sapiens
acgtagattcaggcaagtc

SEQ ID NO: 44459 - DNA, 20 bp, Homo sapiens
atcgacaaaagaaccattga

SEQ ID NO: 44460 - DNA, 17 bp, Homo sapiens
agggcctggacacccct

SEQ ID NO: 44461 - DNA, 21 bp, Homo sapiens
aggggttcaaaccccacctca

SEQ ID NO: 44462 - DNA, 18 bp, Homo sapiens
agtaggtggaggggagcg

SEQ ID NO: 44463 - DNA, 27 bp, Homo sapiens
caaggttggtagtgaatgggcctggtt

SEQ ID NO: 44464 - DNA, 21 bp, Homo sapiens
ccaatggtgcttttggcttta

SEQ ID NO: 44465 - DNA, 19 bp, Homo sapiens
ccacttcatatttgttata

SEQ ID NO: 44466 - DNA, 18 bp, Homo sapiens
ccccacatgtcatggcaa

SEQ ID NO: 44467 - DNA, 25 bp, Homo sapiens
cccttcccccacccagagactgggc

SEQ ID NO: 44468 - DNA, 29 bp, Homo sapiens
gcctggccgcacccaacctgtgttgttgc

SEQ ID NO: 44469 - DNA, 22 bp, Homo sapiens
ggcatgaccaaacctcagtgga

SEQ ID NO: 44470 - DNA, 21 bp, Homo sapiens
tgaagagatccacatttcctt

SEQ ID NO: 44471 - DNA, 20 bp, Homo sapiens
ttcagtcactacagctccga

SEQ ID NO: 44472 - DNA, 18 bp, Homo sapiens
agtgacagtcatgttgaa

SEQ ID NO: 44473 - DNA, 17 bp, Homo sapiens
cggagcaccaccccggc

SEQ ID NO: 44474 - DNA, 24 bp, Homo sapiens
ccccgcccccaatcccccatagct

SEQ ID NO: 44475 - DNA, 19 bp, Homo sapiens
ccttttgatgcccttgaat

SEQ ID NO: 44476 - DNA, 22 bp, Homo sapiens
cgcgcgccatccgtacccgggc

SEQ ID NO: 44477 - DNA, 21 bp, Homo sapiens
gggggagggttgcaagcgcca

SEQ ID NO: 44478 - DNA, 20 bp, Homo sapiens
tgcccaggtgtcccccccag

SEQ ID NO: 44479 - DNA, 18 bp, Homo sapiens
tgctcccaggcaacactg

SEQ ID NO: 44480 - DNA, 19 bp, Homo sapiens
cccaagtatgcttcatctc

SEQ ID NO: 44481 - DNA, 25 bp, Homo sapiens
aaatgcaaagggacaagtatgtgtt

SEQ ID NO: 44482 - DNA, 19 bp, Homo sapiens
acaaacagggcagccagag

SEQ ID NO: 44483 - DNA, 18 bp, Homo sapiens
acccagcttccaaggctg

SEQ ID NO: 44484 - DNA, 17 bp, Homo sapiens
actgtcacgttctgtgg

SEQ ID NO: 44485 - DNA, 22 bp, Homo sapiens
caagaacagggcagcttggacc

SEQ ID NO: 44486 - DNA, 24 bp, Homo sapiens
cagcctgtggtggagggtctctgg

SEQ ID NO: 44487 - DNA, 21 bp, Homo sapiens
cgaggctgcagtgggatgtga

SEQ ID NO: 44488 - DNA, 18 bp, Homo sapiens
cttcatccatacccttct

SEQ ID NO: 44489 - DNA, 18 bp, Homo sapiens
gagattaaacagaggtga

SEQ ID NO: 44490 - DNA, 18 bp, Homo sapiens
gctcccaggggcctgcac

SEQ ID NO: 44491 - DNA, 21 bp, Homo sapiens
tgccggattttgcttcctgca

SEQ ID NO: 44492 - DNA, 23 bp, Homo sapiens
tgctgtgggcccagaagcgccca

SEQ ID NO: 44493 - DNA, 19 bp, Homo sapiens
tgtggtgatgtttttggga

SEQ ID NO: 44494 - DNA, 22 bp, Homo sapiens
ttctaagaaaaacaaaatacaa

SEQ ID NO: 44495 - DNA, 19 bp, Homo sapiens
cgaccaccgcggccgccgg

SEQ ID NO: 44496 - DNA, 19 bp, Homo sapiens
ctgaagacatgctctcaca

SEQ ID NO: 44497 - DNA, 17 bp, Homo sapiens
gaaaacactctgatgta

SEQ ID NO: 44498 - DNA, 19 bp, Homo sapiens
caggccgtcccctccctct

SEQ ID NO: 44499 - DNA, 18 bp, Homo sapiens
cctaactccttatcttca

SEQ ID NO: 44500 - DNA, 20 bp, Homo sapiens
ccttcccctccttcctttcc

SEQ ID NO: 44501 - DNA, 19 bp, Homo sapiens
gtggacagtgccacctcct

SEQ ID NO: 44502 - DNA, 17 bp, Homo sapiens
tgcccaaagccacttct

SEQ ID NO: 44503 - DNA, 24 bp, Homo sapiens
tttaaaattgtcattgtttggttt

SEQ ID NO: 44504 - DNA, 22 bp, Homo sapiens
ttttcgatacaacatcatgaca

SEQ ID NO: 44505 - DNA, 19 bp, Homo sapiens
cagaaaaatccatccgcca

SEQ ID NO: 44506 - DNA, 21 bp, Homo sapiens
gcaatgctctttaccacgttc

SEQ ID NO: 44507 - DNA, 21 bp, Homo sapiens
tcatcatcatcatcatcttcc

SEQ ID NO: 44508 - DNA, 18 bp, Homo sapiens
ccagtggccccacgaagc

SEQ ID NO: 44509 - DNA, 21 bp, Homo sapiens
ctctgctccgagggccagtgg

SEQ ID NO: 44510 - DNA, 18 bp, Homo sapiens
gttccagtggccccacga

SEQ ID NO: 44511 - DNA, 22 bp, Homo sapiens
taagagtaacagcagccaccgc

SEQ ID NO: 44512 - DNA, 19 bp, Homo sapiens
aatgaaattatcaactggc

SEQ ID NO: 44513 - DNA, 24 bp, Homo sapiens
cgcgcgccctccaacctgctgctg

SEQ ID NO: 44514 - DNA, 27 bp, Homo sapiens
acattatgtcagattatgtacttgcta

SEQ ID NO: 44515 - DNA, 19 bp, Homo sapiens
ataacttttcctggcaaca

SEQ ID NO: 44516 - DNA, 22 bp, Homo sapiens
cacttcctcatcactgcagcca

SEQ ID NO: 44517 - DNA, 15 bp, Homo sapiens
ctccttctcatctga

SEQ ID NO: 44518 - DNA, 20 bp, Homo sapiens
gagtttctaccaagatctcc

SEQ ID NO: 44519 - DNA, 23 bp, Homo sapiens
gcataacaaataaactctaagct

SEQ ID NO: 44520 - DNA, 22 bp, Homo sapiens
gctattgttccctggtgttaga

SEQ ID NO: 44521 - DNA, 23 bp, Homo sapiens
acagcgagggcctgtactacctc

SEQ ID NO: 44522 - DNA, 19 bp, Homo sapiens
agccgcagcctcccggcgg

SEQ ID NO: 44523 - DNA, 16 bp, Homo sapiens
aggccccaagccttca

SEQ ID NO: 44524 - DNA, 20 bp, Homo sapiens
gacgtgcagacggtgtcgca

SEQ ID NO: 44525 - DNA, 18 bp, Homo sapiens
ggagccggcccaagccca

SEQ ID NO: 44526 - DNA, 22 bp, Homo sapiens
taaaactgtgaaaaatagctat

SEQ ID NO: 44527 - DNA, 18 bp, Homo sapiens
tggacgaaaatgacgtgc

SEQ ID NO: 44528 - DNA, 18 bp, Homo sapiens
agagattgagacaaaatg

SEQ ID NO: 44529 - DNA, 20 bp, Homo sapiens
tcaaagactactcatttcca

SEQ ID NO: 44530 - DNA, 25 bp, Homo sapiens
tggatagagtgaatcacacctgtaa

SEQ ID NO: 44531 - DNA, 20 bp, Homo sapiens
ccatgaatggcaccatgaca

SEQ ID NO: 44532 - DNA, 22 bp, Homo sapiens
ccctccccttcctcctctgcca

SEQ ID NO: 44533 - DNA, 24 bp, Homo sapiens
ccctggtctgggagtggcctgtgg

SEQ ID NO: 44534 - DNA, 19 bp, Homo sapiens
ctccccttcctcctctgcc

SEQ ID NO: 44535 - DNA, 17 bp, Homo sapiens
ggccattctcctgagct

SEQ ID NO: 44536 - DNA, 21 bp, Homo sapiens
tgtgttctcgtcccctggact

SEQ ID NO: 44537 - DNA, 21 bp, Homo sapiens
gcactcttaccctccttctca

SEQ ID NO: 44538 - DNA, 19 bp, Homo sapiens
acgcttccatctttatcca

SEQ ID NO: 44539 - DNA, 18 bp, Homo sapiens
gtcatttctctcacctct

SEQ ID NO: 44540 - DNA, 23 bp, Homo sapiens
taaatggactaatgatgggattg

SEQ ID NO: 44541 - DNA, 20 bp, Homo sapiens
tatcttcttcttattcttca

SEQ ID NO: 44542 - DNA, 23 bp, Homo sapiens
tctgtctttccaatgttgctttt

SEQ ID NO: 44543 - DNA, 23 bp, Homo sapiens
tgaagaaacaaggagtaaaccca

SEQ ID NO: 44544 - DNA, 24 bp, Homo sapiens
agtcttcatttctttatattgtca

SEQ ID NO: 44545 - DNA, 21 bp, Homo sapiens
ccaaagttatattttatttga

SEQ ID NO: 44546 - DNA, 19 bp, Homo sapiens
ccagagaggttttcctaca

SEQ ID NO: 44547 - DNA, 23 bp, Homo sapiens
tcagcattgtgtagtgttttcta

SEQ ID NO: 44548 - DNA, 21 bp, Homo sapiens
tgagagtttatctttacctca

SEQ ID NO: 44549 - DNA, 19 bp, Homo sapiens
atgtgataacacagatctt

SEQ ID NO: 44550 - DNA, 23 bp, Homo sapiens
gacttcatcagaaaattttgtca

SEQ ID NO: 44551 - DNA, 21 bp, Homo sapiens
gctgagagagatggggtctca

SEQ ID NO: 44552 - DNA, 21 bp, Homo sapiens
aacagagaccctgcctcgaca

SEQ ID NO: 44553 - DNA, 18 bp, Homo sapiens
caacaaaaaaattcctag

SEQ ID NO: 44554 - DNA, 21 bp, Homo sapiens
ccaacatttaaaaagatgcga

SEQ ID NO: 44555 - DNA, 24 bp, Homo sapiens
ccggggtacagagacctgacctca

SEQ ID NO: 44556 - DNA, 20 bp, Homo sapiens
ctgttttgtgaagcatccca

SEQ ID NO: 44557 - DNA, 25 bp, Homo sapiens
aagtatctcatcgaaaaggctcctg

SEQ ID NO: 44558 - DNA, 23 bp, Homo sapiens
caccccgcagcccacgtgtggca

SEQ ID NO: 44559 - DNA, 21 bp, Homo sapiens
aacagctgcaggctccaaaga

SEQ ID NO: 44560 - DNA, 16 bp, Homo sapiens
ctgttctgttttgttt

SEQ ID NO: 44561 - DNA, 22 bp, Homo sapiens
cttcttgattgaggtagcatga

SEQ ID NO: 44562 - DNA, 22 bp, Homo sapiens
tctgagcagagccaccattttt

SEQ ID NO: 44563 - DNA, 21 bp, Homo sapiens
tgacattttcctggccagtga

SEQ ID NO: 44564 - DNA, 20 bp, Homo sapiens
cacaggctacagctgagcaa

SEQ ID NO: 44565 - DNA, 20 bp, Homo sapiens
cctgaggtagtcaggtcatt

SEQ ID NO: 44566 - DNA, 16 bp, Homo sapiens
ctagaggagtcccatc

SEQ ID NO: 44567 - DNA, 25 bp, Homo sapiens
ctttgggatctaagtgtggtttgtg

SEQ ID NO: 44568 - DNA, 20 bp, Homo sapiens
ggtagtcaggtcattgtttc

SEQ ID NO: 44569 - DNA, 17 bp, Homo sapiens
tccttgcgtagtcctca

SEQ ID NO: 44570 - DNA, 20 bp, Homo sapiens
tgttggttctcatctttgaa

SEQ ID NO: 44571 - DNA, 22 bp, Homo sapiens
ccaccagtcccagaacccgcca

SEQ ID NO: 44572 - DNA, 20 bp, Homo sapiens
cccaggcagctgctgcctca

SEQ ID NO: 44573 - DNA, 16 bp, Homo sapiens
ggtccagctcctccct

SEQ ID NO: 44574 - DNA, 21 bp, Homo sapiens
aagcatcgaaatgggatgtct

SEQ ID NO: 44575 - DNA, 20 bp, Homo sapiens
catctgcatccccgagccca

SEQ ID NO: 44576 - DNA, 23 bp, Homo sapiens
ccaacgcgcagtgtgtatttgca

SEQ ID NO: 44577 - DNA, 18 bp, Homo sapiens
ctctctgtcatctcccct

SEQ ID NO: 44578 - DNA, 22 bp, Homo sapiens
tgaatggaaaaatatgaaagta

SEQ ID NO: 44579 - DNA, 22 bp, Homo sapiens
tggcttctctgacctggagctg

SEQ ID NO: 44580 - DNA, 19 bp, Homo sapiens
agccacaaggaacagttct

SEQ ID NO: 44581 - DNA, 16 bp, Homo sapiens
tacagttagcagaccc

SEQ ID NO: 44582 - DNA, 23 bp, Homo sapiens
tctttttgtaacaccttaatttt

SEQ ID NO: 44583 - DNA, 20 bp, Homo sapiens
tggagatggatatgagacta

SEQ ID NO: 44584 - DNA, 23 bp, Homo sapiens
aatcagcacttactaaacatcaa

SEQ ID NO: 44585 - DNA, 18 bp, Homo sapiens
accacaatacatcagaga

SEQ ID NO: 44586 - DNA, 18 bp, Homo sapiens
agagaacacacacaaggg

SEQ ID NO: 44587 - DNA, 20 bp, Homo sapiens
atgaagcaaacacacgtagg

SEQ ID NO: 44588 - DNA, 19 bp, Homo sapiens
caacatagaggaaaccctt

SEQ ID NO: 44589 - DNA, 21 bp, Homo sapiens
cagaaggcagaaatcctgtga

SEQ ID NO: 44590 - DNA, 22 bp, Homo sapiens
cagccacagttcatctatcata

SEQ ID NO: 44591 - DNA, 16 bp, Homo sapiens
cctatgcatgtagtga

SEQ ID NO: 44592 - DNA, 19 bp, Homo sapiens
ctacagcctcctcatctca

SEQ ID NO: 44593 - DNA, 19 bp, Homo sapiens
ggtcttcaagttgcagcaa

SEQ ID NO: 44594 - DNA, 22 bp, Homo sapiens
tcaccttcttggactcgttcca

SEQ ID NO: 44595 - DNA, 20 bp, Homo sapiens
tcgtgggcccgcacttcata

SEQ ID NO: 44596 - DNA, 18 bp, Homo sapiens
ttattagtaatagaagct

SEQ ID NO: 44597 - DNA, 19 bp, Homo sapiens
agctcatgtcagccaggtc

SEQ ID NO: 44598 - DNA, 24 bp, Homo sapiens
ccattgcagagagactccatccca

SEQ ID NO: 44599 - DNA, 21 bp, Homo sapiens
gtgctgtgcagcaaggagccc

SEQ ID NO: 44600 - DNA, 19 bp, Homo sapiens
acacatacatacacacaca

SEQ ID NO: 44601 - DNA, 19 bp, Homo sapiens
cagaacttgaatcctttaa

SEQ ID NO: 44602 - DNA, 18 bp, Homo sapiens
ccaagtttccttgttcct

SEQ ID NO: 44603 - DNA, 22 bp, Homo sapiens
cggaggagggggcggggctctc

SEQ ID NO: 44604 - DNA, 21 bp, Homo sapiens
tggtgtttggcgctggaatta

SEQ ID NO: 44605 - DNA, 20 bp, Homo sapiens
atcaaaaaagccactggaga

SEQ ID NO: 44606 - DNA, 17 bp, Homo sapiens
agaacatagagataggg

SEQ ID NO: 44607 - DNA, 22 bp, Homo sapiens
agaacatgaagaaatgacccca

SEQ ID NO: 44608 - DNA, 17 bp, Homo sapiens
atgagaacaccacacca

SEQ ID NO: 44609 - DNA, 17 bp, Homo sapiens
atgagaacaccacacca

SEQ ID NO: 44610 - DNA, 17 bp, Homo sapiens
atgagaacaccacacca

SEQ ID NO: 44611 - DNA, 17 bp, Homo sapiens
atgagaacaccacacca

SEQ ID NO: 44612 - DNA, 17 bp, Homo sapiens
atgagaacaccacacca

SEQ ID NO: 44613 - DNA, 17 bp, Homo sapiens
atgagaacaccacatca

SEQ ID NO: 44614 - DNA, 19 bp, Homo sapiens
caccacaccatccccagca

SEQ ID NO: 44615 - DNA, 20 bp, Homo sapiens
ccatgagggggaggctgcca

SEQ ID NO: 44616 - DNA, 20 bp, Homo sapiens
gaagaaaactccagcaacca

SEQ ID NO: 44617 - DNA, 19 bp, Homo sapiens
gtatcaagaaggcctgcca

SEQ ID NO: 44618 - DNA, 18 bp, Homo sapiens
tttggctacacttgtgaa

SEQ ID NO: 44619 - DNA, 18 bp, Homo sapiens
ctgggacccgtgcgggga

SEQ ID NO: 44620 - DNA, 21 bp, Homo sapiens
acaataatgaggccagaagta

SEQ ID NO: 44621 - DNA, 21 bp, Homo sapiens
atgcgtcacatgggcatttca

SEQ ID NO: 44622 - DNA, 18 bp, Homo sapiens
cccgcgctgcgcgcccgg

SEQ ID NO: 44623 - DNA, 20 bp, Homo sapiens
tatcaccttattttatcgaa

SEQ ID NO: 44624 - DNA, 20 bp, Homo sapiens
gttatgacttggactggaca

SEQ ID NO: 44625 - DNA, 16 bp, Homo sapiens
accacagcagtgatgc

SEQ ID NO: 44626 - DNA, 18 bp, Homo sapiens
cagcagtgatgccagctg

SEQ ID NO: 44627 - DNA, 17 bp, Homo sapiens
ccaccttgtcaccctca

SEQ ID NO: 44628 - DNA, 22 bp, Homo sapiens
cccctgctgtgtcccatccccc

SEQ ID NO: 44629 - DNA, 24 bp, Homo sapiens
ctgtttcacccctgctgtgtccca

SEQ ID NO: 44630 - DNA, 18 bp, Homo sapiens
gacccaagggtccctgga

SEQ ID NO: 44631 - DNA, 19 bp, Homo sapiens
gcagtgatgccagctgggc

SEQ ID NO: 44632 - DNA, 21 bp, Homo sapiens
ttccagagacggtgtttccag

SEQ ID NO: 44633 - DNA, 22 bp, Homo sapiens
ccactgctccttctaacatttt

SEQ ID NO: 44634 - DNA, 17 bp, Homo sapiens
ccgtctcccgggttcaa

SEQ ID NO: 44635 - DNA, 20 bp, Homo sapiens
cctaagcgtcctttacatta

SEQ ID NO: 44636 - DNA, 21 bp, Homo sapiens
ccttgggagagagggcttcgg

SEQ ID NO: 44637 - DNA, 19 bp, Homo sapiens
gtggacagcagccaccctt

SEQ ID NO: 44638 - DNA, 21 bp, Homo sapiens
tgatgcacacaccaagtggta

SEQ ID NO: 44639 - DNA, 23 bp, Homo sapiens
ttctaacgttttttcatcatagt

SEQ ID NO: 44640 - DNA, 24 bp, Homo sapiens
tctaaacaggcttaatgattcttc

SEQ ID NO: 44641 - DNA, 22 bp, Homo sapiens
tgagtaatcttgtaagcattaa

SEQ ID NO: 44642 - DNA, 20 bp, Homo sapiens
ttgccagaatcattacctgt

SEQ ID NO: 44643 - DNA, 18 bp, Homo sapiens
agaaaaacctttatttgg

SEQ ID NO: 44644 - DNA, 22 bp, Homo sapiens
atattcattcttgtttcacaaa

SEQ ID NO: 44645 - DNA, 25 bp, Homo sapiens
gatttttttttaattgcaaagacta

SEQ ID NO: 44646 - DNA, 21 bp, Homo sapiens
tcttgctgttgccttattttt

SEQ ID NO: 44647 - DNA, 22 bp, Homo sapiens
ttgctgttgccttatttttgat

SEQ ID NO: 44648 - DNA, 21 bp, Homo sapiens
aggcacttaggcctcgcctcc

SEQ ID NO: 44649 - DNA, 22 bp, Homo sapiens
agttggtgccgttggtgccgcc

SEQ ID NO: 44650 - DNA, 18 bp, Homo sapiens
cgccgctatcgcacggga

SEQ ID NO: 44651 - DNA, 21 bp, Homo sapiens
gcctaccatggtcacccatga

SEQ ID NO: 44652 - DNA, 19 bp, Homo sapiens
tgcgcccggctcccggggg

SEQ ID NO: 44653 - DNA, 19 bp, Homo sapiens
tggctgcacatatacctta

SEQ ID NO: 44654 - DNA, 21 bp, Homo sapiens
accccagaagccctgacctca

SEQ ID NO: 44655 - DNA, 18 bp, Homo sapiens
caccaccacccactgccc

SEQ ID NO: 44656 - DNA, 23 bp, Homo sapiens
cctcatttgggcaccttgctgtc

SEQ ID NO: 44657 - DNA, 18 bp, Homo sapiens
cctggcggtccttggcct

SEQ ID NO: 44658 - DNA, 24 bp, Homo sapiens
ggcacaaaagccggtgtccaggga

SEQ ID NO: 44659 - DNA, 16 bp, Homo sapiens
agggctacatccagca

SEQ ID NO: 44660 - DNA, 26 bp, Homo sapiens
caattttttaagatgaagaagtggga

SEQ ID NO: 44661 - DNA, 21 bp, Homo sapiens
cctccccctttccttctctcc

SEQ ID NO: 44662 - DNA, 20 bp, Homo sapiens
gcccaccccacccaagattc

SEQ ID NO: 44663 - DNA, 25 bp, Homo sapiens
ggaaaaggaaatgcgctcccctcca

SEQ ID NO: 44664 - DNA, 19 bp, Homo sapiens
ttgcagtatacaagctttt

SEQ ID NO: 44665 - DNA, 21 bp, Homo sapiens
ctgcctgggtctcctccctca

SEQ ID NO: 44666 - DNA, 19 bp, Homo sapiens
gctcggtgactcacgtctg

SEQ ID NO: 44667 - DNA, 18 bp, Homo sapiens
gtgctttggtcacaaagc

SEQ ID NO: 44668 - DNA, 25 bp, Homo sapiens
taagaggaacggctgggatcagtta

SEQ ID NO: 44669 - DNA, 18 bp, Homo sapiens
tggagatgcctccctcca

SEQ ID NO: 44670 - DNA, 19 bp, Homo sapiens
tttctgatcaattatcggc

SEQ ID NO: 44671 - DNA, 20 bp, Homo sapiens
ccttcccagcaaggatatca

SEQ ID NO: 44672 - DNA, 20 bp, Homo sapiens
gcaaggatatcacactccta

SEQ ID NO: 44673 - DNA, 18 bp, Homo sapiens
tatgtggagaaacatttt

SEQ ID NO: 44674 - DNA, 23 bp, Homo sapiens
tcaggtcttcccattttgcctca

SEQ ID NO: 44675 - DNA, 19 bp, Homo sapiens
tttacattgtcagagtgaa

SEQ ID NO: 44676 - DNA, 17 bp, Homo sapiens
aaggcagcaagcaaggc

SEQ ID NO: 44677 - DNA, 20 bp, Homo sapiens
agtcctccaagaagatgcca

SEQ ID NO: 44678 - DNA, 18 bp, Homo sapiens
cattgtctcctccttaga

SEQ ID NO: 44679 - DNA, 16 bp, Homo sapiens
tgcctcgctgaaaagt

SEQ ID NO: 44680 - DNA, 18 bp, Homo sapiens
acgttccaaatacattat

SEQ ID NO: 44681 - DNA, 18 bp, Homo sapiens
ctgccttgccggcctgct

SEQ ID NO: 44682 - DNA, 21 bp, Homo sapiens
ggttctgactctgtcacccag

SEQ ID NO: 44683 - DNA, 19 bp, Homo sapiens
tcagtggggttcaccttca

SEQ ID NO: 44684 - DNA, 20 bp, Homo sapiens
aaacactgtcaaggatttca

SEQ ID NO: 44685 - DNA, 18 bp, Homo sapiens
acgttccaaatacattat

SEQ ID NO: 44686 - DNA, 18 bp, Homo sapiens
ctgccttgccggcctgct

SEQ ID NO: 44687 - DNA, 24 bp, Homo sapiens
gagctctctattctgtttcattga

SEQ ID NO: 44688 - DNA, 21 bp, Homo sapiens
ggttctgactctgtcacccag

SEQ ID NO: 44689 - DNA, 19 bp, Homo sapiens
tcagtggggttcaccttca

SEQ ID NO: 44690 - DNA, 18 bp, Homo sapiens
tttgctatttattcttgt

SEQ ID NO: 44691 - DNA, 18 bp, Homo sapiens
aacaagataaaaaataca

SEQ ID NO: 44692 - DNA, 20 bp, Homo sapiens
cctctgcctcccaggttcaa

SEQ ID NO: 44693 - DNA, 18 bp, Homo sapiens
gctgtaattagagtcatg

SEQ ID NO: 44694 - DNA, 25 bp, Homo sapiens
tcctaatttaggccctcccaacgaa

SEQ ID NO: 44695 - DNA, 19 bp, Homo sapiens
ttattatgtcacctttcct

SEQ ID NO: 44696 - DNA, 21 bp, Homo sapiens
accagatgaaacctctccagg

SEQ ID NO: 44697 - DNA, 20 bp, Homo sapiens
atcctgtgcagtttacaaca

SEQ ID NO: 44698 - DNA, 18 bp, Homo sapiens
ctcctcctcctcttcctc

SEQ ID NO: 44699 - DNA, 23 bp, Homo sapiens
gccccgctgcccccctcctcctc

SEQ ID NO: 44700 - DNA, 17 bp, Homo sapiens
gcgcacgatctccgggt

SEQ ID NO: 44701 - DNA, 21 bp, Homo sapiens
ctgaccaggctagaccacacg

SEQ ID NO: 44702 - DNA, 20 bp, Homo sapiens
gcccgcttccccaacacctc

SEQ ID NO: 44703 - DNA, 21 bp, Homo sapiens
tgtgcgacttcaggcatatca

SEQ ID NO: 44704 - DNA, 19 bp, Homo sapiens
agaatctcaacgtgctgta

SEQ ID NO: 44705 - DNA, 22 bp, Homo sapiens
agaggggatgaatcatttcagg

SEQ ID NO: 44706 - DNA, 22 bp, Homo sapiens
tgagatcatggctaggaaacgg

SEQ ID NO: 44707 - DNA, 19 bp, Homo sapiens
tgggaccagcacggggctg

SEQ ID NO: 44708 - DNA, 20 bp, Homo sapiens
ccatcctaggcaaaaactcc

SEQ ID NO: 44709 - DNA, 20 bp, Homo sapiens
gccggatagtacgcttccta

SEQ ID NO: 44710 - DNA, 22 bp, Homo sapiens
gcgtcgtggtagctaccacgct

SEQ ID NO: 44711 - DNA, 18 bp, Homo sapiens
ggccacgacaacatcaca

SEQ ID NO: 44712 - DNA, 22 bp, Homo sapiens
gtatgtatggcgctttggttga

SEQ ID NO: 44713 - DNA, 20 bp, Homo sapiens
ttcaagactagcctgaccaa

SEQ ID NO: 44714 - DNA, 26 bp, Homo sapiens
agaaaggcagctcccttcaccttccc

SEQ ID NO: 44715 - DNA, 19 bp, Homo sapiens
aggagagaaaggcagctcc

SEQ ID NO: 44716 - DNA, 19 bp, Homo sapiens
agttcaacaaagccttcta

SEQ ID NO: 44717 - DNA, 16 bp, Homo sapiens
atgtctggtcctctga

SEQ ID NO: 44718 - DNA, 20 bp, Homo sapiens
cggcgggtcacgacatcggc

SEQ ID NO: 44719 - DNA, 18 bp, Homo sapiens
tccgaaactgaagactct

SEQ ID NO: 44720 - DNA, 19 bp, Homo sapiens
ctgcaacctctgcctccca

SEQ ID NO: 44721 - DNA, 22 bp, Homo sapiens
gtatatagattattttcgatta

SEQ ID NO: 44722 - DNA, 18 bp, Homo sapiens
taagtggatctcaccaga

SEQ ID NO: 44723 - DNA, 23 bp, Homo sapiens
aaaacaaaaaggattacccaaac

SEQ ID NO: 44724 - DNA, 22 bp, Homo sapiens
aaacagttccagcaggctctct

SEQ ID NO: 44725 - DNA, 18 bp, Homo sapiens
aagaggaatggtactaca

SEQ ID NO: 44726 - DNA, 23 bp, Homo sapiens
agcttctggtgcttaaccacatc

SEQ ID NO: 44727 - DNA, 19 bp, Homo sapiens
gccctgtgattttttttaa

SEQ ID NO: 44728 - DNA, 19 bp, Homo sapiens
taatccatgagaggtgttt

SEQ ID NO: 44729 - DNA, 20 bp, Homo sapiens
tgaatggacttcttaagctg

SEQ ID NO: 44730 - DNA, 21 bp, Homo sapiens
tgttttgagcttttgactaat

SEQ ID NO: 44731 - DNA, 17 bp, Homo sapiens
acttaggaggtattaca

SEQ ID NO: 44732 - DNA, 18 bp, Homo sapiens
agtccttaggaacagata

SEQ ID NO: 44733 - DNA, 22 bp, Homo sapiens
catttttacagctaccctgatt

SEQ ID NO: 44734 - DNA, 17 bp, Homo sapiens
gaataaattactgcttt

SEQ ID NO: 44735 - DNA, 23 bp, Homo sapiens
gaggctagaagttccgcttgcca

SEQ ID NO: 44736 - DNA, 22 bp, Homo sapiens
acacattattaggcctttgcca

SEQ ID NO: 44737 - DNA, 17 bp, Homo sapiens
tctgaaaacaccagtct

SEQ ID NO: 44738 - DNA, 19 bp, Homo sapiens
gcagccatcaactgcctct

SEQ ID NO: 44739 - DNA, 19 bp, Homo sapiens
tctattgcagagcacagca

SEQ ID NO: 44740 - DNA, 17 bp, Homo sapiens
tgcaaatgactagttca

SEQ ID NO: 44741 - DNA, 17 bp, Homo sapiens
tgggaacgccgctccag

SEQ ID NO: 44742 - DNA, 21 bp, Homo sapiens
ttagtattcttttttttctca

SEQ ID NO: 44743 - DNA, 18 bp, Homo sapiens
tactgacaccacagcagt

SEQ ID NO: 44744 - DNA, 17 bp, Homo sapiens
caaatccacagtatact

SEQ ID NO: 44745 - DNA, 19 bp, Homo sapiens
tttgtcaacaccaattaca

SEQ ID NO: 44746 - DNA, 16 bp, Homo sapiens
tctagaaaaccagctt

SEQ ID NO: 44747 - DNA, 18 bp, Homo sapiens
ttccagaaacggtgctcc

SEQ ID NO: 44748 - DNA, 20 bp, Homo sapiens
taactgtgaaatactctcca

SEQ ID NO: 44749 - DNA, 18 bp, Homo sapiens
agtaagatgtcctctttc

SEQ ID NO: 44750 - DNA, 19 bp, Homo sapiens
agtcctgttggttgagtca

SEQ ID NO: 44751 - DNA, 20 bp, Homo sapiens
atccaatgcctcgagcccac

SEQ ID NO: 44752 - DNA, 20 bp, Homo sapiens
catccaatgcctcgagccca

SEQ ID NO: 44753 - DNA, 18 bp, Homo sapiens
ctgggcagctgtctgcct

SEQ ID NO: 44754 - DNA, 17 bp, Homo sapiens
ctgggcctccctggctt

SEQ ID NO: 44755 - DNA, 18 bp, Homo sapiens
gcaagtgcccctgcttca

SEQ ID NO: 44756 - DNA, 21 bp, Homo sapiens
gcctctctacggctctgcttc

SEQ ID NO: 44757 - DNA, 20 bp, Homo sapiens
gcgccccggcagtcaggata

SEQ ID NO: 44758 - DNA, 19 bp, Homo sapiens
tcaagtgccattcctgcaa

SEQ ID NO: 44759 - DNA, 19 bp, Homo sapiens
tgcctctgtcggagactag

SEQ ID NO: 44760 - DNA, 22 bp, Homo sapiens
acagaaattttagctcttttct

SEQ ID NO: 44761 - DNA, 21 bp, Homo sapiens
cgggtcggcgttgggctcagt

SEQ ID NO: 44762 - DNA, 25 bp, Homo sapiens
ctttggaaagtagttgtttaacttt

SEQ ID NO: 44763 - DNA, 18 bp, Homo sapiens
gaccagcactccctccca

SEQ ID NO: 44764 - DNA, 19 bp, Homo sapiens
gccgcggtgggggacccgg

SEQ ID NO: 44765 - DNA, 20 bp, Homo sapiens
gcctgaatttctgcttggtt

SEQ ID NO: 44766 - DNA, 19 bp, Homo sapiens
tcctttaaaaaatatttgg

SEQ ID NO: 44767 - DNA, 18 bp, Homo sapiens
gagagagagaaaaaacct

SEQ ID NO: 44768 - DNA, 21 bp, Homo sapiens
tcctgaggaaattatccgaga

SEQ ID NO: 44769 - DNA, 20 bp, Homo sapiens
tatgctaagatgattattat

SEQ ID NO: 44770 - DNA, 20 bp, Homo sapiens
acacagtgtgctctctagtt

SEQ ID NO: 44771 - DNA, 23 bp, Homo sapiens
tttgcatcgcttgagtcattttt

SEQ ID NO: 44772 - DNA, 20 bp, Homo sapiens
gaccagccacagaaccagct

SEQ ID NO: 44773 - DNA, 24 bp, Homo sapiens
tcactgagcaaaggagcaactgtc

SEQ ID NO: 44774 - DNA, 20 bp, Homo sapiens
aggtaacccagaatctccca

SEQ ID NO: 44775 - DNA, 18 bp, Homo sapiens
ttttctcagagaagttcc

SEQ ID NO: 44776 - DNA, 24 bp, Homo sapiens
accagcagccatccctttccctct

SEQ ID NO: 44777 - DNA, 18 bp, Homo sapiens
aaacaatcaaatgtaata

SEQ ID NO: 44778 - DNA, 18 bp, Homo sapiens
agagtatgttatcacctc

SEQ ID NO: 44779 - DNA, 22 bp, Homo sapiens
gaaaaaaatccaagacaagtta

SEQ ID NO: 44780 - DNA, 21 bp, Homo sapiens
tggcaacctgccttctggcca

SEQ ID NO: 44781 - DNA, 21 bp, Homo sapiens
atcgtgggcatcgtctggctc

SEQ ID NO: 44782 - DNA, 16 bp, Homo sapiens
catgtacctgatgcgg

SEQ ID NO: 44783 - DNA, 16 bp, Homo sapiens
ccaaggatcctcacca

SEQ ID NO: 44784 - DNA, 24 bp, Homo sapiens
ccatcctctccttccttctgcgcc

SEQ ID NO: 44785 - DNA, 21 bp, Homo sapiens
cgggatcgtggtgttccggcg

SEQ ID NO: 44786 - DNA, 22 bp, Homo sapiens
ctctgggccctgggatctggaa

SEQ ID NO: 44787 - DNA, 24 bp, Homo sapiens
gcctctcatgctgcctcctctgcc

SEQ ID NO: 44788 - DNA, 20 bp, Homo sapiens
tctgacaagcaccgtggcca

SEQ ID NO: 44789 - DNA, 22 bp, Homo sapiens
tgcccatgggtcctgggcaccc

SEQ ID NO: 44790 - DNA, 19 bp, Homo sapiens
tgtgaccaccccagctgca

SEQ ID NO: 44791 - DNA, 18 bp, Homo sapiens
ttctggcccccggctccc

SEQ ID NO: 44792 - DNA, 20 bp, Homo sapiens
actagggagatgactgagaa

SEQ ID NO: 44793 - DNA, 19 bp, Homo sapiens
atctgtgagttattgtcac

SEQ ID NO: 44794 - DNA, 20 bp, Homo sapiens
atgctgtctctgcagtactg

SEQ ID NO: 44795 - DNA, 17 bp, Homo sapiens
cagcaacaaggtaccat

SEQ ID NO: 44796 - DNA, 22 bp, Homo sapiens
gaagaaaagtttgaaaccatga

SEQ ID NO: 44797 - DNA, 18 bp, Homo sapiens
ggactcagcagacaccaa

SEQ ID NO: 44798 - DNA, 19 bp, Homo sapiens
aaacacatatcaagatcca

SEQ ID NO: 44799 - DNA, 19 bp, Homo sapiens
agtcatttccacagcctca

SEQ ID NO: 44800 - DNA, 17 bp, Homo sapiens
gcaacctcagccagtga

SEQ ID NO: 44801 - DNA, 17 bp, Homo sapiens
aacccagccccgggtca

SEQ ID NO: 44802 - DNA, 18 bp, Homo sapiens
actgcctgtggcacccat

SEQ ID NO: 44803 - DNA, 21 bp, Homo sapiens
atccagaagagcagaaggcta

SEQ ID NO: 44804 - DNA, 20 bp, Homo sapiens
ccacctcagctcccacctcc

SEQ ID NO: 44805 - DNA, 23 bp, Homo sapiens
ccttaaagttgtaagcctttaaa

SEQ ID NO: 44806 - DNA, 19 bp, Homo sapiens
ccttagaaaaaagcagtcc

SEQ ID NO: 44807 - DNA, 21 bp, Homo sapiens
gaccctggcaagcggagaagc

SEQ ID NO: 44808 - DNA, 20 bp, Homo sapiens
gctccgggaacagagtgggg

SEQ ID NO: 44809 - DNA, 18 bp, Homo sapiens
ggaccagccacttcctct

SEQ ID NO: 44810 - DNA, 18 bp, Homo sapiens
gggatcctgggcctgtta

SEQ ID NO: 44811 - DNA, 19 bp, Homo sapiens
tagtgcttgaagcctctca

SEQ ID NO: 44812 - DNA, 21 bp, Homo sapiens
tgaacccaccatcttcctgct

SEQ ID NO: 44813 - DNA, 24 bp, Homo sapiens
tgggtggactccggtaggccagct

SEQ ID NO: 44814 - DNA, 21 bp, Homo sapiens
cagtgagagaccaagaaccca

SEQ ID NO: 44815 - DNA, 21 bp, Homo sapiens
ccaacagcagttggggtgtcc

SEQ ID NO: 44816 - DNA, 18 bp, Homo sapiens
aatctcattcattcctaa

SEQ ID NO: 44817 - DNA, 23 bp, Homo sapiens
accagcactgtgtccctccccct

SEQ ID NO: 44818 - DNA, 21 bp, Homo sapiens
cattgaccctctcctttccca

SEQ ID NO: 44819 - DNA, 24 bp, Homo sapiens
cccaactcccttctcaacatgggg

SEQ ID NO: 44820 - DNA, 22 bp, Homo sapiens
cctcttcccaactcccttctca

SEQ ID NO: 44821 - DNA, 17 bp, Homo sapiens
cttccccagctccctcc

SEQ ID NO: 44822 - DNA, 20 bp, Homo sapiens
tcagttcctctcctgttcct

SEQ ID NO: 44823 - DNA, 24 bp, Homo sapiens
cacagtgaccccgacgttgggctg

SEQ ID NO: 44824 - DNA, 22 bp, Homo sapiens
ccttcgccacagcccttagagt

SEQ ID NO: 44825 - DNA, 18 bp, Homo sapiens
ctgagcctgccctggctt

SEQ ID NO: 44826 - DNA, 19 bp, Homo sapiens
gtatcaggaaggtacctgt

SEQ ID NO: 44827 - DNA, 18 bp, Homo sapiens
tcattagtgcagaactca

SEQ ID NO: 44828 - DNA, 20 bp, Homo sapiens
tctgccagtgccttgatctt

SEQ ID NO: 44829 - DNA, 22 bp, Homo sapiens
aagattaggtcctcagcagcat

SEQ ID NO: 44830 - DNA, 22 bp, Homo sapiens
aaggcacttggagcaaaggtca

SEQ ID NO: 44831 - DNA, 16 bp, Homo sapiens
ctgatatcttgctgta

SEQ ID NO: 44832 - DNA, 17 bp, Homo sapiens
cttaaggcacttggagc

SEQ ID NO: 44833 - DNA, 21 bp, Homo sapiens
gtattacaacatcactgcgct

SEQ ID NO: 44834 - DNA, 20 bp, Homo sapiens
tgggggcaagttttagatga

SEQ ID NO: 44835 - DNA, 19 bp, Homo sapiens
ggcagggtgaggggcgcca

SEQ ID NO: 44836 - DNA, 20 bp, Homo sapiens
aaagtgctgtacaaattcca

SEQ ID NO: 44837 - DNA, 21 bp, Homo sapiens
cgcccagtgagccagccccca

SEQ ID NO: 44838 - DNA, 21 bp, Homo sapiens
gggcggggcaacggctcccca

SEQ ID NO: 44839 - DNA, 17 bp, Homo sapiens
ggtttcctgtcccccca

SEQ ID NO: 44840 - DNA, 22 bp, Homo sapiens
atctgaaaaccctgcttggttc

SEQ ID NO: 44841 - DNA, 23 bp, Homo sapiens
cctccccaagcctgtgtctgtga

SEQ ID NO: 44842 - DNA, 23 bp, Homo sapiens
ctgtggatgtgagcattgctttg

SEQ ID NO: 44843 - DNA, 20 bp, Homo sapiens
gaactaattctgttacgtca

SEQ ID NO: 44844 - DNA, 23 bp, Homo sapiens
gaggaagtgtcatcctctggctt

SEQ ID NO: 44845 - DNA, 18 bp, Homo sapiens
taattcctagtcattttt

SEQ ID NO: 44846 - DNA, 18 bp, Homo sapiens
tagatgggctcttctgga

SEQ ID NO: 44847 - DNA, 21 bp, Homo sapiens
taggtggttgatttgaaactg

SEQ ID NO: 44848 - DNA, 16 bp, Homo sapiens
tccagccctgcactgc

SEQ ID NO: 44849 - DNA, 19 bp, Homo sapiens
cagcctgccgtttgccact

SEQ ID NO: 44850 - DNA, 19 bp, Homo sapiens
cgccaatgcccctgcctct

SEQ ID NO: 44851 - DNA, 18 bp, Homo sapiens
gaacatatctgcagagcc

SEQ ID NO: 44852 - DNA, 24 bp, Homo sapiens
gaaccaggaagactcatgtgtggg

SEQ ID NO: 44853 - DNA, 18 bp, Homo sapiens
aggagtttgaccagatga

SEQ ID NO: 44854 - DNA, 24 bp, Homo sapiens
ctctggccaccaagaatttgtgaa

SEQ ID NO: 44855 - DNA, 20 bp, Homo sapiens
gcctgaggccaccatgccac

SEQ ID NO: 44856 - DNA, 22 bp, Homo sapiens
gggaaggaggctgctgggtagc

SEQ ID NO: 44857 - DNA, 18 bp, Homo sapiens
gtagcatgagttgcccaa

SEQ ID NO: 44858 - DNA, 20 bp, Homo sapiens
ttgatgacctccaatagctc

SEQ ID NO: 44859 - DNA, 22 bp, Homo sapiens
cccagacctaggggctccccaa

SEQ ID NO: 44860 - DNA, 22 bp, Homo sapiens
gccctggcccccacaggctcag

SEQ ID NO: 44861 - DNA, 22 bp, Homo sapiens
gcctgcccccactgtctggcct

SEQ ID NO: 44862 - DNA, 21 bp, Homo sapiens
gtgtctccaagcttcccagtg

SEQ ID NO: 44863 - DNA, 18 bp, Homo sapiens
cccctccccactctgatc

SEQ ID NO: 44864 - DNA, 21 bp, Homo sapiens
ccttggcagaggggtctggag

SEQ ID NO: 44865 - DNA, 21 bp, Homo sapiens
gccatttctgagggcaaatca

SEQ ID NO: 44866 - DNA, 24 bp, Homo sapiens
gcgtcagatggcactggcgggttt

SEQ ID NO: 44867 - DNA, 21 bp, Homo sapiens
ggcagaagctccactagctca

SEQ ID NO: 44868 - DNA, 18 bp, Homo sapiens
tttccaggatgtttgtgt

SEQ ID NO: 44869 - DNA, 17 bp, Homo sapiens
tcaagtgattctcctgc

SEQ ID NO: 44870 - DNA, 20 bp, Homo sapiens
tggccaggctggtcttgaac

SEQ ID NO: 44871 - DNA, 18 bp, Homo sapiens
ttccagaaagcatgtccg

SEQ ID NO: 44872 - DNA, 16 bp, Homo sapiens
agtaccatggttctga

SEQ ID NO: 44873 - DNA, 21 bp, Homo sapiens
cagaattccacccatctttca

SEQ ID NO: 44874 - DNA, 25 bp, Homo sapiens
ccatcccaggtcaccacctggctga

SEQ ID NO: 44875 - DNA, 21 bp, Homo sapiens
ccatggttctgacagagactg

SEQ ID NO: 44876 - DNA, 17 bp, Homo sapiens
cctccaacttgacatca

SEQ ID NO: 44877 - DNA, 21 bp, Homo sapiens
cactgaaaagaatccatttaa

SEQ ID NO: 44878 - DNA, 20 bp, Homo sapiens
cctgcaccaccgtttttgaa

SEQ ID NO: 44879 - DNA, 18 bp, Homo sapiens
aacagtagccaaacccct

SEQ ID NO: 44880 - DNA, 20 bp, Homo sapiens
aggactgcagcatcttcatc

SEQ ID NO: 44881 - DNA, 19 bp, Homo sapiens
cttccccagacttgcactg

SEQ ID NO: 44882 - DNA, 18 bp, Homo sapiens
gccttcagcagcagctca

SEQ ID NO: 44883 - DNA, 18 bp, Homo sapiens
ttggagtgactgtctggc

SEQ ID NO: 44884 - DNA, 24 bp, Homo sapiens
aagatgcatgagacattgtagtca

SEQ ID NO: 44885 - DNA, 24 bp, Homo sapiens
atatcgaatccctctttcatgaga

SEQ ID NO: 44886 - DNA, 18 bp, Homo sapiens
caactagtccttgtgatt

SEQ ID NO: 44887 - DNA, 18 bp, Homo sapiens
caccagcagatcatcttt

SEQ ID NO: 44888 - DNA, 20 bp, Homo sapiens
caggattcctgggttctgtt

SEQ ID NO: 44889 - DNA, 19 bp, Homo sapiens
ctgcaacctccgcctccca

SEQ ID NO: 44890 - DNA, 21 bp, Homo sapiens
gatctcaggtgatctaccctc

SEQ ID NO: 44891 - DNA, 23 bp, Homo sapiens
gcctgagccaccgcgcccggcct

SEQ ID NO: 44892 - DNA, 20 bp, Homo sapiens
tgagtcattggctgggttct

SEQ ID NO: 44893 - DNA, 22 bp, Homo sapiens
ccatgtggaataaaacgacgag

SEQ ID NO: 44894 - DNA, 22 bp, Homo sapiens
cgtccccgccaaccctgctcgc

SEQ ID NO: 44895 - DNA, 23 bp, Homo sapiens
tggcgaaccacacgacgctgcgg

SEQ ID NO: 44896 - DNA, 21 bp, Homo sapiens
agccatcctgtcttctgcttg

SEQ ID NO: 44897 - DNA, 23 bp, Homo sapiens
accgcggacatcacaccattcca

SEQ ID NO: 44898 - DNA, 18 bp, Homo sapiens
agacttgtgatcacgccc

SEQ ID NO: 44899 - DNA, 22 bp, Homo sapiens
cggcccaggttccccgcacctc

SEQ ID NO: 44900 - DNA, 23 bp, Homo sapiens
gctctgggctcagggaagctgcg

SEQ ID NO: 44901 - DNA, 18 bp, Homo sapiens
agaatctaagatgtagta

SEQ ID NO: 44902 - DNA, 21 bp, Homo sapiens
gcctgtagtcccagatactca

SEQ ID NO: 44903 - DNA, 18 bp, Homo sapiens
ggaatctcagtgcagtgt

SEQ ID NO: 44904 - DNA, 17 bp, Homo sapiens
tcaagtgattctcctgc

SEQ ID NO: 44905 - DNA, 20 bp, Homo sapiens
tggtcaggctggtcttgaac

SEQ ID NO: 44906 - DNA, 21 bp, Homo sapiens
tttgtaaatatgctgtagtca

SEQ ID NO: 44907 - DNA, 22 bp, Homo sapiens
gagaccagcatctcggcctgag

SEQ ID NO: 44908 - DNA, 18 bp, Homo sapiens
ctgagcatatgcctggct

SEQ ID NO: 44909 - DNA, 18 bp, Homo sapiens
ggtcctttgttgttttta

SEQ ID NO: 44910 - DNA, 19 bp, Homo sapiens
tcagatcatcaccatgcca

SEQ ID NO: 44911 - DNA, 22 bp, Homo sapiens
tttcccccagtattggttttca

SEQ ID NO: 44912 - DNA, 17 bp, Homo sapiens
tcaagtgattctcctgc

SEQ ID NO: 44913 - DNA, 19 bp, Homo sapiens
acaaggcttcaggttcgtc

SEQ ID NO: 44914 - DNA, 16 bp, Homo sapiens
actgacacgtgccagc

SEQ ID NO: 44915 - DNA, 21 bp, Homo sapiens
agaaaggtgatggccaagata

SEQ ID NO: 44916 - DNA, 19 bp, Homo sapiens
agccaacccaaacccgcgc

SEQ ID NO: 44917 - DNA, 19 bp, Homo sapiens
caacccttggtctactgct

SEQ ID NO: 44918 - DNA, 19 bp, Homo sapiens
cattagaagagatgccttt

SEQ ID NO: 44919 - DNA, 18 bp, Homo sapiens
ctgctgcatggctggcca

SEQ ID NO: 44920 - DNA, 25 bp, Homo sapiens
gagactaatatcagagtacccagca

SEQ ID NO: 44921 - DNA, 20 bp, Homo sapiens
gcaagagtataggacattga

SEQ ID NO: 44922 - DNA, 23 bp, Homo sapiens
gcccttctcgttctgtaaagaaa

SEQ ID NO: 44923 - DNA, 21 bp, Homo sapiens
ggcgagctcccccgcgccgca

SEQ ID NO: 44924 - DNA, 18 bp, Homo sapiens
tctttctcccaggcctca

SEQ ID NO: 44925 - DNA, 19 bp, Homo sapiens
agctcttactctcttctgt

SEQ ID NO: 44926 - DNA, 19 bp, Homo sapiens
caaagagccgcactgctcc

SEQ ID NO: 44927 - DNA, 21 bp, Homo sapiens
cctcctgcctgcacgccttca

SEQ ID NO: 44928 - DNA, 16 bp, Homo sapiens
ctgatggcccctggag

SEQ ID NO: 44929 - DNA, 21 bp, Homo sapiens
ctttttactaacaaaatacaa

SEQ ID NO: 44930 - DNA, 19 bp, Homo sapiens
tgggtggatcctacttgga

SEQ ID NO: 44931 - DNA, 17 bp, Homo sapiens
ttctttgtctttggcct

SEQ ID NO: 44932 - DNA, 19 bp, Homo sapiens
agtcataatgttcatcata

SEQ ID NO: 44933 - DNA, 16 bp, Homo sapiens
atgcagctggatctaa

SEQ ID NO: 44934 - DNA, 18 bp, Homo sapiens
gagtggaagtggatgcac

SEQ ID NO: 44935 - DNA, 19 bp, Homo sapiens
gtggctttttgtttcccca

SEQ ID NO: 44936 - DNA, 21 bp, Homo sapiens
ctctgggaaagatttcatttt

SEQ ID NO: 44937 - DNA, 19 bp, Homo sapiens
gacattcagttctgtaaga

SEQ ID NO: 44938 - DNA, 19 bp, Homo sapiens
gtataagcacatttgactg

SEQ ID NO: 44939 - DNA, 19 bp, Homo sapiens
gctccaaaatcccatttga

SEQ ID NO: 44940 - DNA, 20 bp, Homo sapiens
aacgatgtttatatgttaag

SEQ ID NO: 44941 - DNA, 22 bp, Homo sapiens
ctgacaactggcaaagatgtca

SEQ ID NO: 44942 - DNA, 18 bp, Homo sapiens
cttcattattgtttcctt

SEQ ID NO: 44943 - DNA, 26 bp, Homo sapiens
ctttggtccacctggaggcccgtgaa

SEQ ID NO: 44944 - DNA, 21 bp, Homo sapiens
taaaggacatttcctggtctt

SEQ ID NO: 44945 - DNA, 19 bp, Homo sapiens
tcgatgaatttaaacctca

SEQ ID NO: 44946 - DNA, 22 bp, Homo sapiens
tggatgtttctagtgggagctg

SEQ ID NO: 44947 - DNA, 19 bp, Homo sapiens
taaagaagaactgaagata

SEQ ID NO: 44948 - DNA, 21 bp, Homo sapiens
accaggcctaggatctcccca

SEQ ID NO: 44949 - DNA, 20 bp, Homo sapiens
ccaagggccccacccagctc

SEQ ID NO: 44950 - DNA, 21 bp, Homo sapiens
ctgactcttacatttctttgg

SEQ ID NO: 44951 - DNA, 18 bp, Homo sapiens
gcagccgctcctctcctc

SEQ ID NO: 44952 - DNA, 21 bp, Homo sapiens
cctggcacacagacataaagc

SEQ ID NO: 44953 - DNA, 17 bp, Homo sapiens
ctggctgtccctggcct

SEQ ID NO: 44954 - DNA, 18 bp, Homo sapiens
gcaccacttcctgccccc

SEQ ID NO: 44955 - DNA, 25 bp, Homo sapiens
tgggtgggagatggacgttaggctg

SEQ ID NO: 44956 - DNA, 17 bp, Homo sapiens
ttcaagtggcatcaatg

SEQ ID NO: 44957 - DNA, 19 bp, Homo sapiens
ctgaaatgcctcttcttcc

SEQ ID NO: 44958 - DNA, 23 bp, Homo sapiens
cttctttgttcctctctgcccct

SEQ ID NO: 44959 - DNA, 18 bp, Homo sapiens
tgaggctatatggggctg

SEQ ID NO: 44960 - DNA, 18 bp, Homo sapiens
ttttcctgcctcttgata

SEQ ID NO: 44961 - DNA, 18 bp, Homo sapiens
accagagaagtgctaggc

SEQ ID NO: 44962 - DNA, 20 bp, Homo sapiens
agtttggctgtgtccccacc

SEQ ID NO: 44963 - DNA, 19 bp, Homo sapiens
cttttaaggtattatctca

SEQ ID NO: 44964 - DNA, 22 bp, Homo sapiens
tcagtcattgcacaagtgcttg

SEQ ID NO: 44965 - DNA, 18 bp, Homo sapiens
ttgttatctctgcttgca

SEQ ID NO: 44966 - DNA, 20 bp, Homo sapiens
acaggacctacctcatagaa

SEQ ID NO: 44967 - DNA, 19 bp, Homo sapiens
acctttaaatggaatccca

SEQ ID NO: 44968 - DNA, 20 bp, Homo sapiens
cctgagtagttccttccctt

SEQ ID NO: 44969 - DNA, 18 bp, Homo sapiens
gtgcttcacctccattta

SEQ ID NO: 44970 - DNA, 22 bp, Homo sapiens
tatgtactatagacatgttaat

SEQ ID NO: 44971 - DNA, 23 bp, Homo sapiens
tgaaggcactctggcataggctg

SEQ ID NO: 44972 - DNA, 19 bp, Homo sapiens
tgggccataacatgccttt

SEQ ID NO: 44973 - DNA, 20 bp, Homo sapiens
tgtatcagaaatgcatacct

SEQ ID NO: 44974 - DNA, 24 bp, Homo sapiens
atggattccgtattttgatatgaa

SEQ ID NO: 44975 - DNA, 20 bp, Homo sapiens
tcaaagaggcaaggtgcccc

SEQ ID NO: 44976 - DNA, 18 bp, Homo sapiens
agccgcagcctccgccac

SEQ ID NO: 44977 - DNA, 19 bp, Homo sapiens
ccccgcccgcggccccacc

SEQ ID NO: 44978 - DNA, 24 bp, Homo sapiens
cgccacagccgccgcctccacccc

SEQ ID NO: 44979 - DNA, 19 bp, Homo sapiens
gcctccacccccggcccca

SEQ ID NO: 44980 - DNA, 23 bp, Homo sapiens
ggaactcgccgcccgctcgctct

SEQ ID NO: 44981 - DNA, 18 bp, Homo sapiens
tgggaagcaagtttgtca

SEQ ID NO: 44982 - DNA, 19 bp, Homo sapiens
cccacatgttgacagtaga

SEQ ID NO: 44983 - DNA, 20 bp, Homo sapiens
gcaaggagcaaatggcctca

SEQ ID NO: 44984 - DNA, 22 bp, Homo sapiens
tttctttattccatgttctata

SEQ ID NO: 44985 - DNA, 20 bp, Homo sapiens
aggcacttgaggccttgctt

SEQ ID NO: 44986 - DNA, 20 bp, Homo sapiens
cttttctctacatacagtgc

SEQ ID NO: 44987 - DNA, 21 bp, Homo sapiens
gcttcttggagcctctgggga

SEQ ID NO: 44988 - DNA, 19 bp, Homo sapiens
tagtcccatctgcatttca

SEQ ID NO: 44989 - DNA, 19 bp, Homo sapiens
aaacagaaaccctgagccg

SEQ ID NO: 44990 - DNA, 20 bp, Homo sapiens
catttatcttcccccaccct

SEQ ID NO: 44991 - DNA, 20 bp, Homo sapiens
agtagccagctcaccaaggc

SEQ ID NO: 44992 - DNA, 24 bp, Homo sapiens
cctcacccctttgccttgctgtct

SEQ ID NO: 44993 - DNA, 24 bp, Homo sapiens
ctgtaaatgtctaggcatgtgctg

SEQ ID NO: 44994 - DNA, 19 bp, Homo sapiens
gctgtctgtctccacccca

SEQ ID NO: 44995 - DNA, 21 bp, Homo sapiens
ggatggcttgacctgggattg

SEQ ID NO: 44996 - DNA, 18 bp, Homo sapiens
ggcccacatgtctgacca

SEQ ID NO: 44997 - DNA, 23 bp, Homo sapiens
tgtaaatgtctaggcatgtgctg

SEQ ID NO: 44998 - DNA, 18 bp, Homo sapiens
ttctggcctctcatccca

SEQ ID NO: 44999 - DNA, 16 bp, Homo sapiens
ttgttgcctgcactca

SEQ ID NO: 45000 - DNA, 21 bp, Homo sapiens
tctggttgaaccacgtggcca

SEQ ID NO: 45001 - DNA, 21 bp, Homo sapiens
tgtgttggcttaatttctgga

SEQ ID NO: 45002 - DNA, 22 bp, Homo sapiens
gacctaatttgcagacgagccc

SEQ ID NO: 45003 - DNA, 21 bp, Homo sapiens
gagtgtacgctcaaaccgttt

SEQ ID NO: 45004 - DNA, 20 bp, Homo sapiens
gcttctcccatccctgcctt

SEQ ID NO: 45005 - DNA, 19 bp, Homo sapiens
ggccttcctgcctcccaca

SEQ ID NO: 45006 - DNA, 22 bp, Homo sapiens
tcagggagagccaagcacattt

SEQ ID NO: 45007 - DNA, 21 bp, Homo sapiens
acaaaaagcccaacatgcatt

SEQ ID NO: 45008 - DNA, 19 bp, Homo sapiens
cccaacatgcattgctagt

SEQ ID NO: 45009 - DNA, 24 bp, Homo sapiens
tccgccacattgtggagcgtgctt

SEQ ID NO: 45010 - DNA, 18 bp, Homo sapiens
tgggtggatcacttgagg

SEQ ID NO: 45011 - DNA, 19 bp, Homo sapiens
aaaccttaaaatttggtga

SEQ ID NO: 45012 - DNA, 22 bp, Homo sapiens
cttggctccagctggtccctcc

SEQ ID NO: 45013 - DNA, 22 bp, Homo sapiens
gagccaagaccgcaccactgca

SEQ ID NO: 45014 - DNA, 21 bp, Homo sapiens
gtgataaatatccatgaaatc

SEQ ID NO: 45015 - DNA, 21 bp, Homo sapiens
tgggtggatcacctgaggtta

SEQ ID NO: 45016 - DNA, 20 bp, Homo sapiens
cacttttcctatctgtctta

SEQ ID NO: 45017 - DNA, 17 bp, Homo sapiens
ctccctctcagaagcca

SEQ ID NO: 45018 - DNA, 20 bp, Homo sapiens
tagctttcttacagcgtctt

SEQ ID NO: 45019 - DNA, 22 bp, Homo sapiens
aggaaggtaaataaccaaaaca

SEQ ID NO: 45020 - DNA, 19 bp, Homo sapiens
ctcaaaaagtgcaaaagca

SEQ ID NO: 45021 - DNA, 19 bp, Homo sapiens
cttcttcatttctgtgagg

SEQ ID NO: 45022 - DNA, 24 bp, Homo sapiens
ggcaaataagcctgcattgtcata

SEQ ID NO: 45023 - DNA, 19 bp, Homo sapiens
tgaaactgctgaaatcata

SEQ ID NO: 45024 - DNA, 21 bp, Homo sapiens
ttgcattattatagactggga

SEQ ID NO: 45025 - DNA, 22 bp, Homo sapiens
gacagcgttgtgtctcccctca

SEQ ID NO: 45026 - DNA, 21 bp, Homo sapiens
agagggtggagtgaggatgca

SEQ ID NO: 45027 - DNA, 20 bp, Homo sapiens
agttgttattgttgtttttg

SEQ ID NO: 45028 - DNA, 19 bp, Homo sapiens
ctggtaataaaactacaca

SEQ ID NO: 45029 - DNA, 21 bp, Homo sapiens
ctttcctctcctctttcttca

SEQ ID NO: 45030 - DNA, 21 bp, Homo sapiens
tcttgagataatgaaaagtga

SEQ ID NO: 45031 - DNA, 19 bp, Homo sapiens
agctctggaggagccctcg

SEQ ID NO: 45032 - DNA, 21 bp, Homo sapiens
gtcatagaggcttgattttta

SEQ ID NO: 45033 - DNA, 23 bp, Homo sapiens
tggatggagggagcgtgtgagat

SEQ ID NO: 45034 - DNA, 22 bp, Homo sapiens
agcccatgaatcagccgcggtc

SEQ ID NO: 45035 - DNA, 18 bp, Homo sapiens
aggaaatgtaataaattc

SEQ ID NO: 45036 - DNA, 20 bp, Homo sapiens
cccatggatggctgttctcc

SEQ ID NO: 45037 - DNA, 21 bp, Homo sapiens
actaatctctatcccagatga

SEQ ID NO: 45038 - DNA, 24 bp, Homo sapiens
agaaagtcatcattactgctttga

SEQ ID NO: 45039 - DNA, 18 bp, Homo sapiens
cctgcaacctccacctcc

SEQ ID NO: 45040 - DNA, 19 bp, Homo sapiens
accaaagaacagatcctgg

SEQ ID NO: 45041 - DNA, 20 bp, Homo sapiens
aggatgtgtggtcctggtga

SEQ ID NO: 45042 - DNA, 22 bp, Homo sapiens
agacactggaaagagaatacta

SEQ ID NO: 45043 - DNA, 15 bp, Homo sapiens
aggagacccctccca

SEQ ID NO: 45044 - DNA, 21 bp, Homo sapiens
agttgcacatgttttccccta

SEQ ID NO: 45045 - DNA, 20 bp, Homo sapiens
ggcctcactctgttgcacaa

SEQ ID NO: 45046 - DNA, 17 bp, Homo sapiens
tcaaaatctccacagta

SEQ ID NO: 45047 - DNA, 17 bp, Homo sapiens
aatagtggggagtgcta

SEQ ID NO: 45048 - DNA, 22 bp, Homo sapiens
ccacgcttcagacttcttccct

SEQ ID NO: 45049 - DNA, 17 bp, Homo sapiens
cccagctcattttgcag

SEQ ID NO: 45050 - DNA, 18 bp, Homo sapiens
ctccctagtgaccaggga

SEQ ID NO: 45051 - DNA, 23 bp, Homo sapiens
ctgacttctttggagacacaccg

SEQ ID NO: 45052 - DNA, 20 bp, Homo sapiens
ggacaacatgtccttcctct

SEQ ID NO: 45053 - DNA, 20 bp, Homo sapiens
tttaacatataatatagcag

SEQ ID NO: 45054 - DNA, 18 bp, Homo sapiens
aaaggagaatgtgtgata

SEQ ID NO: 45055 - DNA, 23 bp, Homo sapiens
agacccccaccccccgacccccc

SEQ ID NO: 45056 - DNA, 16 bp, Homo sapiens
ccagaactatcagaga

SEQ ID NO: 45057 - DNA, 19 bp, Homo sapiens
gatcagagctcacctttct

SEQ ID NO: 45058 - DNA, 17 bp, Homo sapiens
gctagaacccagagagg

SEQ ID NO: 45059 - DNA, 18 bp, Homo sapiens
gctcctggcatggaactg

SEQ ID NO: 45060 - DNA, 17 bp, Homo sapiens
ggccctgggtggaattg

SEQ ID NO: 45061 - DNA, 19 bp, Homo sapiens
tggatgggcttctatcaga

SEQ ID NO: 45062 - DNA, 16 bp, Homo sapiens
tgtcaaggccttgctc

SEQ ID NO: 45063 - DNA, 21 bp, Homo sapiens
ttttccaacccaaaagcagac

SEQ ID NO: 45064 - DNA, 19 bp, Homo sapiens
ttttggcggcgccctctgc

SEQ ID NO: 45065 - DNA, 25 bp, Homo sapiens
aataacctgttcatatgccaattca

SEQ ID NO: 45066 - DNA, 19 bp, Homo sapiens
agaatggatgcttccatca

SEQ ID NO: 45067 - DNA, 19 bp, Homo sapiens
ccattagggaccatctgtg

SEQ ID NO: 45068 - DNA, 18 bp, Homo sapiens
cacacatacatagacaca

SEQ ID NO: 45069 - DNA, 21 bp, Homo sapiens
tcgccaggtgactgtcccacc

SEQ ID NO: 45070 - DNA, 22 bp, Homo sapiens
cccactctccaccccgccgcca

SEQ ID NO: 45071 - DNA, 16 bp, Homo sapiens
ggcagcggcgctaagc

SEQ ID NO: 45072 - DNA, 21 bp, Homo sapiens
ccaagtgttgtgactgtgcca

SEQ ID NO: 45073 - DNA, 20 bp, Homo sapiens
gggacggccccaccaccacc

SEQ ID NO: 45074 - DNA, 20 bp, Homo sapiens
aactctgtcaactcgaaata

SEQ ID NO: 45075 - DNA, 18 bp, Homo sapiens
ggcctggaaaccacgctg

SEQ ID NO: 45076 - DNA, 21 bp, Homo sapiens
cgggcggtgcgctgcaggcca

SEQ ID NO: 45077 - DNA, 20 bp, Homo sapiens
gcgcagagggctggctggga

SEQ ID NO: 45078 - DNA, 18 bp, Homo sapiens
ggtcttcgaaaccctctc

SEQ ID NO: 45079 - DNA, 26 bp, Homo sapiens
taaattttactccaaccatgtgtaca

SEQ ID NO: 45080 - DNA, 21 bp, Homo sapiens
tctttcccactcagttttgca

SEQ ID NO: 45081 - DNA, 23 bp, Homo sapiens
agctacagaattttgccagatga

SEQ ID NO: 45082 - DNA, 18 bp, Homo sapiens
atcatttgttaatgatgt

SEQ ID NO: 45083 - DNA, 22 bp, Homo sapiens
caagatgtccttaggtctggtt

SEQ ID NO: 45084 - DNA, 17 bp, Homo sapiens
gaacaatgtgtaaaata

SEQ ID NO: 45085 - DNA, 24 bp, Homo sapiens
gggctgttattcagaacaccgcac

SEQ ID NO: 45086 - DNA, 18 bp, Homo sapiens
tctgctgacattccttgg

SEQ ID NO: 45087 - DNA, 19 bp, Homo sapiens
ctagtagttctttaacttt

SEQ ID NO: 45088 - DNA, 19 bp, Homo sapiens
aattgaatctgcagcatct

SEQ ID NO: 45089 - DNA, 20 bp, Homo sapiens
acctgctccacaatctccat

SEQ ID NO: 45090 - DNA, 23 bp, Homo sapiens
caaaacacaatgacttggttact

SEQ ID NO: 45091 - DNA, 19 bp, Homo sapiens
ctagtagttctttaacttt

SEQ ID NO: 45092 - DNA, 19 bp, Homo sapiens
ctctctggcaagaacatta

SEQ ID NO: 45093 - DNA, 22 bp, Homo sapiens
ctttccattgaccattatgact

SEQ ID NO: 45094 - DNA, 19 bp, Homo sapiens
gtgtgtatccaatgtttta

SEQ ID NO: 45095 - DNA, 23 bp, Homo sapiens
taaaaacaaactttaacaaagag

SEQ ID NO: 45096 - DNA, 24 bp, Homo sapiens
tagcccctcccccacatacacaca

SEQ ID NO: 45097 - DNA, 21 bp, Homo sapiens
tcctttttttgtaaaatacct

SEQ ID NO: 45098 - DNA, 24 bp, Homo sapiens
tttgggtatatgtacatacattca

SEQ ID NO: 45099 - DNA, 17 bp, Homo sapiens
aggtgggggggtgctca

SEQ ID NO: 45100 - DNA, 20 bp, Homo sapiens
tccctgctccacagctttca

SEQ ID NO: 45101 - DNA, 21 bp, Homo sapiens
acttaaggatccttctagtca

SEQ ID NO: 45102 - DNA, 22 bp, Homo sapiens
ccaaaaaagattcggttgtcaa

SEQ ID NO: 45103 - DNA, 17 bp, Homo sapiens
ctccccataacaagaga

SEQ ID NO: 45104 - DNA, 22 bp, Homo sapiens
tctttggcctctccttggcttt

SEQ ID NO: 45105 - DNA, 17 bp, Homo sapiens
ttgggacatgctgctca

SEQ ID NO: 45106 - DNA, 17 bp, Homo sapiens
agaacctctgggatctc

SEQ ID NO: 45107 - DNA, 21 bp, Homo sapiens
gaggataagctaacgatgctg

SEQ ID NO: 45108 - DNA, 21 bp, Homo sapiens
ggattccactgcagctgtggc

SEQ ID NO: 45109 - DNA, 20 bp, Homo sapiens
tgaggctgcttcgccagtga

SEQ ID NO: 45110 - DNA, 19 bp, Homo sapiens
acaaacagcattaacgtca

SEQ ID NO: 45111 - DNA, 19 bp, Homo sapiens
agcattaacgtcacctggg

SEQ ID NO: 45112 - DNA, 25 bp, Homo sapiens
agcttctccaaagtgactaacatca

SEQ ID NO: 45113 - DNA, 20 bp, Homo sapiens
cttgagcaattttaatctct

SEQ ID NO: 45114 - DNA, 20 bp, Homo sapiens
tggccaggctggtcttgaac

SEQ ID NO: 45115 - DNA, 17 bp, Homo sapiens
aaaaacaaacaaacaaa

SEQ ID NO: 45116 - DNA, 18 bp, Homo sapiens
ccacctcaaaaaaacaac

SEQ ID NO: 45117 - DNA, 20 bp, Homo sapiens
ctgcttcactgcgtcatcat

SEQ ID NO: 45118 - DNA, 22 bp, Homo sapiens
actttaggcctcaacgtcctca

SEQ ID NO: 45119 - DNA, 20 bp, Homo sapiens
ggcttctgcaggaggccatt

SEQ ID NO: 45120 - DNA, 20 bp, Homo sapiens
ttaagagtacataatgttcc

SEQ ID NO: 45121 - DNA, 18 bp, Homo sapiens
agccaaggactcctgaca

SEQ ID NO: 45122 - DNA, 23 bp, Homo sapiens
agctggggcagtccagtcactca

SEQ ID NO: 45123 - DNA, 19 bp, Homo sapiens
ccattgccagccttgctgt

SEQ ID NO: 45124 - DNA, 19 bp, Homo sapiens
cgcggccgtcccgatttcc

SEQ ID NO: 45125 - DNA, 18 bp, Homo sapiens
ggagagaaaaaagtgact

SEQ ID NO: 45126 - DNA, 18 bp, Homo sapiens
tctgaaggcagctgtgca

SEQ ID NO: 45127 - DNA, 25 bp, Homo sapiens
tgctgtcagattcaaaattgctttt

SEQ ID NO: 45128 - DNA, 22 bp, Homo sapiens
ttgcttgtgaacaatgctttta

SEQ ID NO: 45129 - DNA, 17 bp, Homo sapiens
actgacaccatgggctg

SEQ ID NO: 45130 - DNA, 20 bp, Homo sapiens
atggccccacagccattgca

SEQ ID NO: 45131 - DNA, 24 bp, Homo sapiens
cccagatccatccactccacccca

SEQ ID NO: 45132 - DNA, 21 bp, Homo sapiens
ccccatttactgtcgtcccca

SEQ ID NO: 45133 - DNA, 20 bp, Homo sapiens
cgcactgccacactgctcac

SEQ ID NO: 45134 - DNA, 17 bp, Homo sapiens
gtccccagcctcaggtg

SEQ ID NO: 45135 - DNA, 18 bp, Homo sapiens
gttcattttccccgagga

SEQ ID NO: 45136 - DNA, 17 bp, Homo sapiens
tcaagtgattctcctgc

SEQ ID NO: 45137 - DNA, 18 bp, Homo sapiens
tccgcctcctgggttcaa

SEQ ID NO: 45138 - DNA, 20 bp, Homo sapiens
tggccaggctggtcttgaac

SEQ ID NO: 45139 - DNA, 30 bp, Homo sapiens
cggacatttaatcggagaacctcctgggga

SEQ ID NO: 45140 - DNA, 18 bp, Homo sapiens
ggagagagcaagcccctt

SEQ ID NO: 45141 - DNA, 20 bp, Homo sapiens
gtctttttgatagcaaatta

SEQ ID NO: 45142 - DNA, 18 bp, Homo sapiens
tgatgacttcactgggag

SEQ ID NO: 45143 - DNA, 23 bp, Homo sapiens
atttgattcctcatttgccacat

SEQ ID NO: 45144 - DNA, 22 bp, Homo sapiens
catgcttttccagctcatcaca

SEQ ID NO: 45145 - DNA, 16 bp, Homo sapiens
tgatggatatttggaa

SEQ ID NO: 45146 - DNA, 25 bp, Homo sapiens
tggaataaccacatggctaccttct

SEQ ID NO: 45147 - DNA, 17 bp, Homo sapiens
cttttaactgcaaccac

SEQ ID NO: 45148 - DNA, 19 bp, Homo sapiens
ttatacttgccttggcttt

SEQ ID NO: 45149 - DNA, 17 bp, Homo sapiens
atcccaaacagcattag

SEQ ID NO: 45150 - DNA, 22 bp, Homo sapiens
ccagacagaaagctgacagtct

SEQ ID NO: 45151 - DNA, 18 bp, Homo sapiens
ccagctgccagcctgaga

SEQ ID NO: 45152 - DNA, 18 bp, Homo sapiens
ccccacggcggcccgcaa

SEQ ID NO: 45153 - DNA, 20 bp, Homo sapiens
cccgccgccccgcgtcccgg

SEQ ID NO: 45154 - DNA, 19 bp, Homo sapiens
ctattaaagagcctttcaa

SEQ ID NO: 45155 - DNA, 24 bp, Homo sapiens
ctgtttcataagagcacaatgtac

SEQ ID NO: 45156 - DNA, 21 bp, Homo sapiens
aatccctactttgtcatatca

SEQ ID NO: 45157 - DNA, 22 bp, Homo sapiens
acaactccttcattctttgtga

SEQ ID NO: 45158 - DNA, 23 bp, Homo sapiens
accctgaaactacacaccatttc

SEQ ID NO: 45159 - DNA, 19 bp, Homo sapiens
cgtgttggcgggagcctgt

SEQ ID NO: 45160 - DNA, 22 bp, Homo sapiens
gcaagatttgtgttggttttga

SEQ ID NO: 45161 - DNA, 17 bp, Homo sapiens
tactttgtcatatcaga

SEQ ID NO: 45162 - DNA, 22 bp, Homo sapiens
ttctgctcaggagttctgtgag

SEQ ID NO: 45163 - DNA, 21 bp, Homo sapiens
aactagtgaggtctcaagcgg

SEQ ID NO: 45164 - DNA, 20 bp, Homo sapiens
agtaccatacagtcttgatg

SEQ ID NO: 45165 - DNA, 18 bp, Homo sapiens
cttatctcccttctccca

SEQ ID NO: 45166 - DNA, 26 bp, Homo sapiens
cttcattattttgatgacagcattaa

SEQ ID NO: 45167 - DNA, 22 bp, Homo sapiens
gcacttagcactgcctacctca

SEQ ID NO: 45168 - DNA, 18 bp, Homo sapiens
gtgttgatttttgctggt

SEQ ID NO: 45169 - DNA, 19 bp, Homo sapiens
catgtcatccaacccctca

SEQ ID NO: 45170 - DNA, 18 bp, Homo sapiens
tcccaccattttgggctg

SEQ ID NO: 45171 - DNA, 23 bp, Homo sapiens
tcctggttctctgggatctgcgg

SEQ ID NO: 45172 - DNA, 17 bp, Homo sapiens
tgtcatccaacccctca

SEQ ID NO: 45173 - DNA, 26 bp, Homo sapiens
ttgacacaatcagctttacttattca

SEQ ID NO: 45174 - DNA, 22 bp, Homo sapiens
aagaaactgatgaattttctga

SEQ ID NO: 45175 - DNA, 19 bp, Homo sapiens
aagcaattctcctgcctca

SEQ ID NO: 45176 - DNA, 20 bp, Homo sapiens
atctacagccaagcatcaca

SEQ ID NO: 45177 - DNA, 22 bp, Homo sapiens
atcttggctcactgcaacctct

SEQ ID NO: 45178 - DNA, 21 bp, Homo sapiens
cccctccccaccccttcttcc

SEQ ID NO: 45179 - DNA, 21 bp, Homo sapiens
ccctccccaccccttcttccc

SEQ ID NO: 45180 - DNA, 20 bp, Homo sapiens
cctctgcctcccaggttcaa

SEQ ID NO: 45181 - DNA, 19 bp, Homo sapiens
ctgcaacctctgcctccca

SEQ ID NO: 45182 - DNA, 21 bp, Homo sapiens
cttcgttgcttctttggtctt

SEQ ID NO: 45183 - DNA, 21 bp, Homo sapiens
ccccacagcctcccccaagct

SEQ ID NO: 45184 - DNA, 17 bp, Homo sapiens
cggcccgccagcacctc

SEQ ID NO: 45185 - DNA, 17 bp, Homo sapiens
gaggaggtggtacagca

SEQ ID NO: 45186 - DNA, 17 bp, Homo sapiens
gctcctccactgaccca

SEQ ID NO: 45187 - DNA, 24 bp, Homo sapiens
tgaggttaaaaggggttcaggtca

SEQ ID NO: 45188 - DNA, 17 bp, Homo sapiens
gaacctgctaaggccat

SEQ ID NO: 45189 - DNA, 24 bp, Homo sapiens
cctggagtcatctgttttggtctt

SEQ ID NO: 45190 - DNA, 18 bp, Homo sapiens
acactttattatataata

SEQ ID NO: 45191 - DNA, 17 bp, Homo sapiens
agaaagcaagaataggt

SEQ ID NO: 45192 - DNA, 19 bp, Homo sapiens
caaggcagctctgctcagc

SEQ ID NO: 45193 - DNA, 17 bp, Homo sapiens
gtctcagcctgatccca

SEQ ID NO: 45194 - DNA, 23 bp, Homo sapiens
tttgggccctgtctaggttgttt

SEQ ID NO: 45195 - DNA, 17 bp, Homo sapiens
aaagtctcccaacccca

SEQ ID NO: 45196 - DNA, 20 bp, Homo sapiens
ccagtccttcctgcactgct

SEQ ID NO: 45197 - DNA, 21 bp, Homo sapiens
ctgaaaagtctcccaacccca

SEQ ID NO: 45198 - DNA, 20 bp, Homo sapiens
tggccaggctggtcttgaac

SEQ ID NO: 45199 - DNA, 21 bp, Homo sapiens
aagaataccatgaatgtaaga

SEQ ID NO: 45200 - DNA, 20 bp, Homo sapiens
cttgattttaagttgttata

SEQ ID NO: 45201 - DNA, 19 bp, Homo sapiens
ctttgatgataaaacttgt

SEQ ID NO: 45202 - DNA, 17 bp, Homo sapiens
gctatacacataaaaca

SEQ ID NO: 45203 - DNA, 19 bp, Homo sapiens
tatacctctcaacagttta

SEQ ID NO: 45204 - DNA, 22 bp, Homo sapiens
tggtacactctagtgtaggcta

SEQ ID NO: 45205 - DNA, 19 bp, Homo sapiens
ttttagaaattacatgaaa

SEQ ID NO: 45206 - DNA, 22 bp, Homo sapiens
ttttgagaaaaaaagtacggca

SEQ ID NO: 45207 - DNA, 18 bp, Homo sapiens
cgctttggggcagatttt

SEQ ID NO: 45208 - DNA, 22 bp, Homo sapiens
ctgaccagcccaggaggaacca

SEQ ID NO: 45209 - DNA, 18 bp, Homo sapiens
tactaaatcagatttgcc

SEQ ID NO: 45210 - DNA, 20 bp, Homo sapiens
tgaaataaaatatgctttaa

SEQ ID NO: 45211 - DNA, 19 bp, Homo sapiens
accaagaccaaagccagct

SEQ ID NO: 45212 - DNA, 21 bp, Homo sapiens
aggaaaagccatttcaagaca

SEQ ID NO: 45213 - DNA, 17 bp, Homo sapiens
atgcaaccaacagtcaa

SEQ ID NO: 45214 - DNA, 18 bp, Homo sapiens
atttcacccacactgcca

SEQ ID NO: 45215 - DNA, 20 bp, Homo sapiens
tttcaggacttcatcatcac

SEQ ID NO: 45216 - DNA, 18 bp, Homo sapiens
aataccaccaataaatca

SEQ ID NO: 45217 - DNA, 19 bp, Homo sapiens
accaataaatcatcaaaca

SEQ ID NO: 45218 - DNA, 18 bp, Homo sapiens
atgtatcctgcaatactg

SEQ ID NO: 45219 - DNA, 18 bp, Homo sapiens
cacgaacacactttttac

SEQ ID NO: 45220 - DNA, 19 bp, Homo sapiens
caggcttttgcttgctatc

SEQ ID NO: 45221 - DNA, 19 bp, Homo sapiens
ccttaaatcaatttattga

SEQ ID NO: 45222 - DNA, 24 bp, Homo sapiens
ccttttgtatacttctttaatttt

SEQ ID NO: 45223 - DNA, 23 bp, Homo sapiens
cttagttttcttgagtgattttt

SEQ ID NO: 45224 - DNA, 17 bp, Homo sapiens
gaactcctagaaatttc

SEQ ID NO: 45225 - DNA, 18 bp, Homo sapiens
taaatcacttgtcatgat

SEQ ID NO: 45226 - DNA, 19 bp, Homo sapiens
tagaaatttcaagagcata

SEQ ID NO: 45227 - DNA, 20 bp, Homo sapiens
tcaccatgtatcctgcaata

SEQ ID NO: 45228 - DNA, 17 bp, Homo sapiens
tctagctcactgccttt

SEQ ID NO: 45229 - DNA, 18 bp, Homo sapiens
tctttaatgactcttcct

SEQ ID NO: 45230 - DNA, 17 bp, Homo sapiens
tgtcattatttgctggt

SEQ ID NO: 45231 - DNA, 17 bp, Homo sapiens
ttattttgtgtcattga

SEQ ID NO: 45232 - DNA, 21 bp, Homo sapiens
aaacaaccaacccttcatggc

SEQ ID NO: 45233 - DNA, 16 bp, Homo sapiens
aagactgcacctgtta

SEQ ID NO: 45234 - DNA, 24 bp, Homo sapiens
caacccttcatggctctccttcag

SEQ ID NO: 45235 - DNA, 21 bp, Homo sapiens
ccaaacaggatctggaaaacc

SEQ ID NO: 45236 - DNA, 21 bp, Homo sapiens
ccctcacagagttttccacca

SEQ ID NO: 45237 - DNA, 18 bp, Homo sapiens
tgcaaaacagcctccttc

SEQ ID NO: 45238 - DNA, 18 bp, Homo sapiens
aaccctgacttacgtctc

SEQ ID NO: 45239 - DNA, 18 bp, Homo sapiens
cacatgacaggttttcta

SEQ ID NO: 45240 - DNA, 16 bp, Homo sapiens
gagctttcaaatccca

SEQ ID NO: 45241 - DNA, 23 bp, Homo sapiens
acagagacgaagagaccccaaca

SEQ ID NO: 45242 - DNA, 17 bp, Homo sapiens
agaagaacctggaccat

SEQ ID NO: 45243 - DNA, 24 bp, Homo sapiens
cagaaaaaaacataattctggtga

SEQ ID NO: 45244 - DNA, 20 bp, Homo sapiens
ctggaccattcttgatggag

SEQ ID NO: 45245 - DNA, 18 bp, Homo sapiens
cttttcatcctaaatctt

SEQ ID NO: 45246 - DNA, 20 bp, Homo sapiens
tctgtattattacatgtgct

SEQ ID NO: 45247 - DNA, 24 bp, Homo sapiens
agaagaaaactcagtaggcacctt

SEQ ID NO: 45248 - DNA, 19 bp, Homo sapiens
caagatcagcctggcctag

SEQ ID NO: 45249 - DNA, 19 bp, Homo sapiens
tctcttcatggttatgtct

SEQ ID NO: 45250 - DNA, 21 bp, Homo sapiens
tgagtggcaaagcgtgggctg

SEQ ID NO: 45251 - DNA, 20 bp, Homo sapiens
ttccagaaatgagggtggca

SEQ ID NO: 45252 - DNA, 21 bp, Homo sapiens
ccatcctgcaccccagtcccc

SEQ ID NO: 45253 - DNA, 23 bp, Homo sapiens
cgtctgtgggcaccagcacttca

SEQ ID NO: 45254 - DNA, 21 bp, Homo sapiens
ctctcaccccttcgtctgtgg

SEQ ID NO: 45255 - DNA, 19 bp, Homo sapiens
gccctaaataccccagctg

SEQ ID NO: 45256 - DNA, 18 bp, Homo sapiens
tacagaaacctcatccct

SEQ ID NO: 45257 - DNA, 22 bp, Homo sapiens
tactgcctgtttcttactttga

SEQ ID NO: 45258 - DNA, 22 bp, Homo sapiens
tcggtggttctgcccctactcc

SEQ ID NO: 45259 - DNA, 17 bp, Homo sapiens
gactgcaacatctttca

SEQ ID NO: 45260 - DNA, 21 bp, Homo sapiens
caggagttaacttctcagtga

SEQ ID NO: 45261 - DNA, 24 bp, Homo sapiens
cccatatattcaccagttacccca

SEQ ID NO: 45262 - DNA, 26 bp, Homo sapiens
gataattccgaaacgcctgcacatga

SEQ ID NO: 45263 - DNA, 19 bp, Homo sapiens
caggcctcaggccccctca

SEQ ID NO: 45264 - DNA, 19 bp, Homo sapiens
ccaaaaatccacattctcc

SEQ ID NO: 45265 - DNA, 21 bp, Homo sapiens
ggtgggtggagggggatgctg

SEQ ID NO: 45266 - DNA, 20 bp, Homo sapiens
tgaatggcctcttctgccag

SEQ ID NO: 45267 - DNA, 20 bp, Homo sapiens
ggcctccacaccacgaaaga

SEQ ID NO: 45268 - DNA, 21 bp, Homo sapiens
cctgcctcctatggcctctca

SEQ ID NO: 45269 - DNA, 16 bp, Homo sapiens
ctggagtgcttggctt

SEQ ID NO: 45270 - DNA, 20 bp, Homo sapiens
ggtatagaatttttgtttag

SEQ ID NO: 45271 - DNA, 22 bp, Homo sapiens
tctctttcatctgcttgacttt

SEQ ID NO: 45272 - DNA, 20 bp, Homo sapiens
gcaccgcgcggggaacccgg

SEQ ID NO: 45273 - DNA, 17 bp, Homo sapiens
agaagaacctggaccat

SEQ ID NO: 45274 - DNA, 24 bp, Homo sapiens
cagaaaaatacataattctggtga

SEQ ID NO: 45275 - DNA, 20 bp, Homo sapiens
ctggaccattcttgatggag

SEQ ID NO: 45276 - DNA, 18 bp, Homo sapiens
cttttcatcctaaatctt

SEQ ID NO: 45277 - DNA, 20 bp, Homo sapiens
tctgtattattatatgtgct

SEQ ID NO: 45278 - DNA, 17 bp, Homo sapiens
aggacttggtgattacc

SEQ ID NO: 45279 - DNA, 19 bp, Homo sapiens
agttgtacaacaccagcaa

SEQ ID NO: 45280 - DNA, 17 bp, Homo sapiens
atgaagttgtacaacac

SEQ ID NO: 45281 - DNA, 22 bp, Homo sapiens
ccttctcaagaccgagtgtaca

SEQ ID NO: 45282 - DNA, 20 bp, Homo sapiens
ctgccattttttgtctgtga

SEQ ID NO: 45283 - DNA, 19 bp, Homo sapiens
ttacagtggcagtattgac

SEQ ID NO: 45284 - DNA, 22 bp, Homo sapiens
ttctacaatacaacacattgaa

SEQ ID NO: 45285 - DNA, 18 bp, Homo sapiens
ttcttcgtggattgtttt

SEQ ID NO: 45286 - DNA, 18 bp, Homo sapiens
tcctaagccaaaagaaca

SEQ ID NO: 45287 - DNA, 17 bp, Homo sapiens
aaacactgaacaacctc

SEQ ID NO: 45288 - DNA, 18 bp, Homo sapiens
actgctgatatttccacc

SEQ ID NO: 45289 - DNA, 22 bp, Homo sapiens
acagagtgcagagaccccggca

SEQ ID NO: 45290 - DNA, 20 bp, Homo sapiens
cagagcacgtgtttcgcggc

SEQ ID NO: 45291 - DNA, 22 bp, Homo sapiens
cctgggtcaaccgccctgcagc

SEQ ID NO: 45292 - DNA, 22 bp, Homo sapiens
cgagacctgcgcgcgctccgcg

SEQ ID NO: 45293 - DNA, 22 bp, Homo sapiens
cgaggcctggtcagcctgcagt

SEQ ID NO: 45294 - DNA, 19 bp, Homo sapiens
cgctgcatttgtaccgctg

SEQ ID NO: 45295 - DNA, 19 bp, Homo sapiens
gcggctgctcacagagcac

SEQ ID NO: 45296 - DNA, 18 bp, Homo sapiens
tctgccctgtggctgctt

SEQ ID NO: 45297 - DNA, 20 bp, Homo sapiens
aatcatagcagcagcagcca

SEQ ID NO: 45298 - DNA, 18 bp, Homo sapiens
cagcagcagccagcacca

SEQ ID NO: 45299 - DNA, 18 bp, Homo sapiens
cactttcacaattagcat

SEQ ID NO: 45300 - DNA, 19 bp, Homo sapiens
ggaggaggaggggatcgcc

SEQ ID NO: 45301 - DNA, 18 bp, Homo sapiens
agctgcccatttcctaca

SEQ ID NO: 45302 - DNA, 20 bp, Homo sapiens
tgcaaggaagaaatacttca

SEQ ID NO: 45303 - DNA, 18 bp, Homo sapiens
cttggacatcctgaacat

SEQ ID NO: 45304 - DNA, 17 bp, Homo sapiens
agaaggttttggataaa

SEQ ID NO: 45305 - DNA, 18 bp, Homo sapiens
tgaatgtgctgccagtga

SEQ ID NO: 45306 - DNA, 19 bp, Homo sapiens
caatggagatattgatgaa

SEQ ID NO: 45307 - DNA, 19 bp, Homo sapiens
ttccatgaaaatgctccag

SEQ ID NO: 45308 - DNA, 22 bp, Homo sapiens
aagcacttaaacgacttcatca

SEQ ID NO: 45309 - DNA, 19 bp, Homo sapiens
ctggtcaaactgggtctgc

SEQ ID NO: 45310 - DNA, 22 bp, Homo sapiens
agaagagaaaggcaagtacctt

SEQ ID NO: 45311 - DNA, 19 bp, Homo sapiens
gtaccatgatacccctgga

SEQ ID NO: 45312 - DNA, 22 bp, Homo sapiens
agctccttcttttgccatccca

SEQ ID NO: 45313 - DNA, 20 bp, Homo sapiens
atctccaggcccaaaacttc

SEQ ID NO: 45314 - DNA, 26 bp, Homo sapiens
gcctcactgtggaccacccaagccaa

SEQ ID NO: 45315 - DNA, 18 bp, Homo sapiens
atctccctaaggaagagt

SEQ ID NO: 45316 - DNA, 20 bp, Homo sapiens
caaccctctggatcacctct

SEQ ID NO: 45317 - DNA, 22 bp, Homo sapiens
tcaatctcagggataataccca

SEQ ID NO: 45318 - DNA, 18 bp, Homo sapiens
ttccttttagtattcatg

SEQ ID NO: 45319 - DNA, 19 bp, Homo sapiens
ttctctactgaaaatacaa

SEQ ID NO: 45320 - DNA, 22 bp, Homo sapiens
ttgtaaatatgtctgtaatatt

SEQ ID NO: 45321 - DNA, 22 bp, Homo sapiens
gacctcatcactggatttgcca

SEQ ID NO: 45322 - DNA, 19 bp, Homo sapiens
acactcgctgcttaagctc

SEQ ID NO: 45323 - DNA, 21 bp, Homo sapiens
gccaccccagagccctggggg

SEQ ID NO: 45324 - DNA, 21 bp, Homo sapiens
tgcggcctccttgtttgcagg

SEQ ID NO: 45325 - DNA, 23 bp, Homo sapiens
ccattaccaatagattactgatg

SEQ ID NO: 45326 - DNA, 18 bp, Homo sapiens
ctttcagttttccatagc

SEQ ID NO: 45327 - DNA, 21 bp, Homo sapiens
gcgtggtgcagctctgctgct

SEQ ID NO: 45328 - DNA, 22 bp, Homo sapiens
gctcttttggaggccacaggga

SEQ ID NO: 45329 - DNA, 17 bp, Homo sapiens
aggcaagaatggaacgg

SEQ ID NO: 45330 - DNA, 21 bp, Homo sapiens
gcctgcagtatgcagagcccc

SEQ ID NO: 45331 - DNA, 21 bp, Homo sapiens
ggagaaacgatttctgttgac

SEQ ID NO: 45332 - DNA, 19 bp, Homo sapiens
caatgaaacaagacaatga

SEQ ID NO: 45333 - DNA, 21 bp, Homo sapiens
ttgaacctttccttcctgctt

SEQ ID NO: 45334 - DNA, 20 bp, Homo sapiens
ccagtctgaaaaccagaccg

SEQ ID NO: 45335 - DNA, 23 bp, Homo sapiens
gcctggggctgctgatgagcttt

SEQ ID NO: 45336 - DNA, 18 bp, Homo sapiens
gcgtcccgggggttccga

SEQ ID NO: 45337 - DNA, 19 bp, Homo sapiens
accaggagaacctagctca

SEQ ID NO: 45338 - DNA, 22 bp, Homo sapiens
gctggaaatcctggattttttt

SEQ ID NO: 45339 - DNA, 15 bp, Homo sapiens
gtgccagatgcaata

SEQ ID NO: 45340 - DNA, 23 bp, Homo sapiens
ggttgtattttgaatgtaaccaa

SEQ ID NO: 45341 - DNA, 21 bp, Homo sapiens
ttcaattgatgaagatgtgat

SEQ ID NO: 45342 - DNA, 18 bp, Homo sapiens
ttcccttctgtttcttac

SEQ ID NO: 45343 - DNA, 20 bp, Homo sapiens
ttccttttggtcttcatgga

SEQ ID NO: 45344 - DNA, 18 bp, Homo sapiens
ctccgggcagggctggga

SEQ ID NO: 45345 - DNA, 21 bp, Homo sapiens
cagggtgcgctggtcccggtc

SEQ ID NO: 45346 - DNA, 16 bp, Homo sapiens
tgggcaggccactttt

SEQ ID NO: 45347 - DNA, 22 bp, Homo sapiens
gagccaagattgtgccactgca

SEQ ID NO: 45348 - DNA, 16 bp, Homo sapiens
gagtcagctgagcatc

SEQ ID NO: 45349 - DNA, 16 bp, Homo sapiens
ggatggagaaccctcc

SEQ ID NO: 45350 - DNA, 20 bp, Homo sapiens
aacagaggtgagcacctttc

SEQ ID NO: 45351 - DNA, 17 bp, Homo sapiens
aaccttgcatgtcatca

SEQ ID NO: 45352 - DNA, 23 bp, Homo sapiens
tcaccatcaagcaatccatgtca

SEQ ID NO: 45353 - DNA, 20 bp, Homo sapiens
ccatattttatgttgcttta

SEQ ID NO: 45354 - DNA, 24 bp, Homo sapiens
cctccaggctgaaggactgttgta

SEQ ID NO: 45355 - DNA, 22 bp, Homo sapiens
gacggggtttcggcatgttggc

SEQ ID NO: 45356 - DNA, 18 bp, Homo sapiens
gcctgaaatccaatagtc

SEQ ID NO: 45357 - DNA, 20 bp, Homo sapiens
tctctgcctcccaggttcaa

SEQ ID NO: 45358 - DNA, 21 bp, Homo sapiens
cactaataacattgctgtcaa

SEQ ID NO: 45359 - DNA, 18 bp, Homo sapiens
gaataattgaagtccctt

SEQ ID NO: 45360 - DNA, 21 bp, Homo sapiens
tccagctaagagggcccatct

SEQ ID NO: 45361 - DNA, 16 bp, Homo sapiens
tctcacctctttccta

SEQ ID NO: 45362 - DNA, 25 bp, Homo sapiens
tgtaattgagaaaatgttcaccaaa

SEQ ID NO: 45363 - DNA, 19 bp, Homo sapiens
ctactgcccccccccctct

SEQ ID NO: 45364 - DNA, 18 bp, Homo sapiens
ctcctccaaaaccaggga

SEQ ID NO: 45365 - DNA, 21 bp, Homo sapiens
tagggtccctggttccagtta

SEQ ID NO: 45366 - DNA, 22 bp, Homo sapiens
atctccaacccttctgataaca

SEQ ID NO: 45367 - DNA, 22 bp, Homo sapiens
gccctttatccgacggttctgg

SEQ ID NO: 45368 - DNA, 19 bp, Homo sapiens
aaggaaccaagctgacaca

SEQ ID NO: 45369 - DNA, 19 bp, Homo sapiens
caccatttcggacaccccg

SEQ ID NO: 45370 - DNA, 24 bp, Homo sapiens
cccgttaataaaaaccaatgtagg

SEQ ID NO: 45371 - DNA, 22 bp, Homo sapiens
gcggctgcgagggactttgtca

SEQ ID NO: 45372 - DNA, 19 bp, Homo sapiens
agacccactaatttgcaca

SEQ ID NO: 45373 - DNA, 18 bp, Homo sapiens
gagccactcacttttatt

SEQ ID NO: 45374 - DNA, 18 bp, Homo sapiens
ggagctttttaaatctca

SEQ ID NO: 45375 - DNA, 18 bp, Homo sapiens
tgagctcttcattagctc

SEQ ID NO: 45376 - DNA, 19 bp, Homo sapiens
acgaaccattcgcatatgg

SEQ ID NO: 45377 - DNA, 26 bp, Homo sapiens
ggaactgctagaacgaaccattcgca

SEQ ID NO: 45378 - DNA, 19 bp, Homo sapiens
ctgccagttgcattcttcc

SEQ ID NO: 45379 - DNA, 25 bp, Homo sapiens
caaggccgaagggtgacaaaataca

SEQ ID NO: 45380 - DNA, 20 bp, Homo sapiens
ctgcggggtctgcctggcct

SEQ ID NO: 45381 - DNA, 17 bp, Homo sapiens
ctgctgatcctgacgga

SEQ ID NO: 45382 - DNA, 21 bp, Homo sapiens
gacggcgtcctgcgctcccca

SEQ ID NO: 45383 - DNA, 20 bp, Homo sapiens
ggccaagtgcgtgctggccg

SEQ ID NO: 45384 - DNA, 18 bp, Homo sapiens
ccgcctggccttcgggga

SEQ ID NO: 45385 - DNA, 20 bp, Homo sapiens
aggcggaaacagcacttcat

SEQ ID NO: 45386 - DNA, 22 bp, Homo sapiens
ccagcccctgctcagcccctcc

SEQ ID NO: 45387 - DNA, 20 bp, Homo sapiens
gctgccacctcgcccagcca

SEQ ID NO: 45388 - DNA, 19 bp, Homo sapiens
ttcttcatcgttgagcttt

SEQ ID NO: 45389 - DNA, 21 bp, Homo sapiens
agggaaataaaggcagaaggc

SEQ ID NO: 45390 - DNA, 20 bp, Homo sapiens
tctgaagacaatggacccac

SEQ ID NO: 45391 - DNA, 19 bp, Homo sapiens
agcccaccagatgtagcac

SEQ ID NO: 45392 - DNA, 19 bp, Homo sapiens
ccaggccatctctgttcct

SEQ ID NO: 45393 - DNA, 19 bp, Homo sapiens
ccaggtcactgttgcccca

SEQ ID NO: 45394 - DNA, 20 bp, Homo sapiens
gtctggttgcagaacctgca

SEQ ID NO: 45395 - DNA, 20 bp, Homo sapiens
ccacgccgacccctcccctc

SEQ ID NO: 45396 - DNA, 21 bp, Homo sapiens
cccgcttttaccctccccacc

SEQ ID NO: 45397 - DNA, 19 bp, Homo sapiens
tgtctatctcaactctatt

SEQ ID NO: 45398 - DNA, 17 bp, Homo sapiens
tcaaaaattaagcatgt

SEQ ID NO: 45399 - DNA, 18 bp, Homo sapiens
tgaacaatgcttaacata

SEQ ID NO: 45400 - DNA, 16 bp, Homo sapiens
catgagggtgtggtca

SEQ ID NO: 45401 - DNA, 22 bp, Homo sapiens
ccaattaaaaggtgacccaaca

SEQ ID NO: 45402 - DNA, 23 bp, Homo sapiens
cccggctgtggcgcttctgtgga

SEQ ID NO: 45403 - DNA, 18 bp, Homo sapiens
cttccagaagcaacccag

SEQ ID NO: 45404 - DNA, 17 bp, Homo sapiens
tcattgaattctggtga

SEQ ID NO: 45405 - DNA, 20 bp, Homo sapiens
aaacagtgattgagtttgtt

SEQ ID NO: 45406 - DNA, 19 bp, Homo sapiens
tcagtggggcactgaagaa

SEQ ID NO: 45407 - DNA, 18 bp, Homo sapiens
aagaccctaaaactgccc

SEQ ID NO: 45408 - DNA, 19 bp, Homo sapiens
tgaacgacctggtgtctga

SEQ ID NO: 45409 - DNA, 20 bp, Homo sapiens
attctacccacctctatgca

SEQ ID NO: 45410 - DNA, 20 bp, Homo sapiens
ccaccgccaccggctgagct

SEQ ID NO: 45411 - DNA, 19 bp, Homo sapiens
cgcatcctggaaaaaagga

SEQ ID NO: 45412 - DNA, 21 bp, Homo sapiens
gcctgagccccggcctggctc

SEQ ID NO: 45413 - DNA, 22 bp, Homo sapiens
tcacccaacctctcccacctcc

SEQ ID NO: 45414 - DNA, 18 bp, Homo sapiens
tgatgacaaggtgtacta

SEQ ID NO: 45415 - DNA, 20 bp, Homo sapiens
tggcacctgatgtgagactg

SEQ ID NO: 45416 - DNA, 23 bp, Homo sapiens
ttctgactgagctcccccattcc

SEQ ID NO: 45417 - DNA, 24 bp, Homo sapiens
ccacattcccagaaacttccagca

SEQ ID NO: 45418 - DNA, 24 bp, Homo sapiens
tgaatggattttaacaaatggact

SEQ ID NO: 45419 - DNA, 17 bp, Homo sapiens
atgaacaaaaccagtta

SEQ ID NO: 45420 - DNA, 27 bp, Homo sapiens
atggaaagaaaatcccagcaggagctg

SEQ ID NO: 45421 - DNA, 20 bp, Homo sapiens
gcctctgttaaggaggagtc

SEQ ID NO: 45422 - DNA, 23 bp, Homo sapiens
tcggcaagctggagcctctgtta

SEQ ID NO: 45423 - DNA, 26 bp, Homo sapiens
aaggatgtgatattaaagttatgata

SEQ ID NO: 45424 - DNA, 21 bp, Homo sapiens
atatcttgcaaggatgtgata

SEQ ID NO: 45425 - DNA, 19 bp, Homo sapiens
atcttgcaaggatgtgata

SEQ ID NO: 45426 - DNA, 22 bp, Homo sapiens
cttaagtgacttaagttatttt

SEQ ID NO: 45427 - DNA, 19 bp, Homo sapiens
tctaaattcattggtttaa

SEQ ID NO: 45428 - DNA, 21 bp, Homo sapiens
gcagcaatagggttttcatca

SEQ ID NO: 45429 - DNA, 18 bp, Homo sapiens
caaccctgatcctgtcct

SEQ ID NO: 45430 - DNA, 17 bp, Homo sapiens
gttctggaacccagtga

SEQ ID NO: 45431 - DNA, 19 bp, Homo sapiens
tctactccccggacctcaa

SEQ ID NO: 45432 - DNA, 18 bp, Homo sapiens
actgggcaccatcagcta

SEQ ID NO: 45433 - DNA, 20 bp, Homo sapiens
caacttccaggacggagctt

SEQ ID NO: 45434 - DNA, 18 bp, Homo sapiens
agatgggacacaacctca

SEQ ID NO: 45435 - DNA, 20 bp, Homo sapiens
caccatcagagacagccaca

SEQ ID NO: 45436 - DNA, 22 bp, Homo sapiens
gagccaagaccccacaatgcta

SEQ ID NO: 45437 - DNA, 19 bp, Homo sapiens
ggcctggcagacgattata

SEQ ID NO: 45438 - DNA, 22 bp, Homo sapiens
aaaatctcctttctgcttccca

SEQ ID NO: 45439 - DNA, 21 bp, Homo sapiens
gctacagagttccttctcacc

SEQ ID NO: 45440 - DNA, 20 bp, Homo sapiens
ttccagacagaacccggcac

SEQ ID NO: 45441 - DNA, 23 bp, Homo sapiens
cctccccgctaaggctggcgtgc

SEQ ID NO: 45442 - DNA, 17 bp, Homo sapiens
gtgctgagtctgtgaat

SEQ ID NO: 45443 - DNA, 24 bp, Homo sapiens
tgtcctgactgtcctacaatatca

SEQ ID NO: 45444 - DNA, 19 bp, Homo sapiens
aaactcctggcctcaggtg

SEQ ID NO: 45445 - DNA, 22 bp, Homo sapiens
tcacctgcggccacgaccggca

SEQ ID NO: 45446 - DNA, 21 bp, Homo sapiens
acgaagatcctgagacgctta

SEQ ID NO: 45447 - DNA, 21 bp, Homo sapiens
agaaacaacaccacagaaccc

SEQ ID NO: 45448 - DNA, 20 bp, Homo sapiens
cctctgcctcccgggttcaa

SEQ ID NO: 45449 - DNA, 20 bp, Homo sapiens
ctgttttttgttttgttttg

SEQ ID NO: 45450 - DNA, 25 bp, Homo sapiens
gtctggaccctggcttatctggttc

SEQ ID NO: 45451 - DNA, 22 bp, Homo sapiens
tctgcctggcaacctgatctcg

SEQ ID NO: 45452 - DNA, 21 bp, Homo sapiens
acacctcaaccctcctagtca

SEQ ID NO: 45453 - DNA, 22 bp, Homo sapiens
caagcacaaatctgggtcccca

SEQ ID NO: 45454 - DNA, 18 bp, Homo sapiens
gcctcccagcgcctctgc

SEQ ID NO: 45455 - DNA, 22 bp, Homo sapiens
gcctccccacccacctcctgct

SEQ ID NO: 45456 - DNA, 18 bp, Homo sapiens
ggaagagaaactaaccac

SEQ ID NO: 45457 - DNA, 18 bp, Homo sapiens
catgtgcgcatttatgag

SEQ ID NO: 45458 - DNA, 20 bp, Homo sapiens
tccagccccctccatctccc

SEQ ID NO: 45459 - DNA, 17 bp, Homo sapiens
cctgatatgttgctata

SEQ ID NO: 45460 - DNA, 19 bp, Homo sapiens
ctaatggtgactgcttggc

SEQ ID NO: 45461 - DNA, 18 bp, Homo sapiens
gcccagaagagacctcag

SEQ ID NO: 45462 - DNA, 17 bp, Homo sapiens
aatcctagggccacctc

SEQ ID NO: 45463 - DNA, 22 bp, Homo sapiens
acgccccccagtgtccttgaca

SEQ ID NO: 45464 - DNA, 24 bp, Homo sapiens
cctcagactcaaacggccatctca

SEQ ID NO: 45465 - DNA, 18 bp, Homo sapiens
gtgatgacaaactgacca

SEQ ID NO: 45466 - DNA, 17 bp, Homo sapiens
ttcgccggtttcatgaa

SEQ ID NO: 45467 - DNA, 16 bp, Homo sapiens
gagccatccgtgctgc

SEQ ID NO: 45468 - DNA, 17 bp, Homo sapiens
gcagccatccgtgctgc

SEQ ID NO: 45469 - DNA, 20 bp, Homo sapiens
aaagtcaggaggattgacag

SEQ ID NO: 45470 - DNA, 21 bp, Homo sapiens
cacttgtgcccccagctcagc

SEQ ID NO: 45471 - DNA, 17 bp, Homo sapiens
cccacggcccccgcagc

SEQ ID NO: 45472 - DNA, 21 bp, Homo sapiens
cctccttggcgcctgtcccca

SEQ ID NO: 45473 - DNA, 18 bp, Homo sapiens
cctggtgacggggctggc

SEQ ID NO: 45474 - DNA, 20 bp, Homo sapiens
gcccctcagcaccctgcctt

SEQ ID NO: 45475 - DNA, 16 bp, Homo sapiens
gcgcctagggctgcgg

SEQ ID NO: 45476 - DNA, 20 bp, Homo sapiens
tcctggaaggaagatcttgg

SEQ ID NO: 45477 - DNA, 23 bp, Homo sapiens
tgggtggggggcagtgggggctg

SEQ ID NO: 45478 - DNA, 23 bp, Homo sapiens
tttttttacccctccttagcttt

SEQ ID NO: 45479 - DNA, 21 bp, Homo sapiens
ccagggcgagtgacaggcgag

SEQ ID NO: 45480 - DNA, 19 bp, Homo sapiens
tgctacctttttacccaca

SEQ ID NO: 45481 - DNA, 18 bp, Homo sapiens
gcctctggctgctggttt

SEQ ID NO: 45482 - DNA, 19 bp, Homo sapiens
ctgtgatgaaaatcatgtg

SEQ ID NO: 45483 - DNA, 23 bp, Homo sapiens
gtgtagggctaatggtgaatttt

SEQ ID NO: 45484 - DNA, 21 bp, Homo sapiens
tattgagtaagttctgaaaca

SEQ ID NO: 45485 - DNA, 19 bp, Homo sapiens
ctaaaatccacatcaccct

SEQ ID NO: 45486 - DNA, 20 bp, Homo sapiens
ctagctcggcggtcacccca

SEQ ID NO: 45487 - DNA, 18 bp, Homo sapiens
tcaaggataggaagtgtt

SEQ ID NO: 45488 - DNA, 18 bp, Homo sapiens
cttcccatccgctctcca

SEQ ID NO: 45489 - DNA, 19 bp, Homo sapiens
tgcccagatgggctctcca

SEQ ID NO: 45490 - DNA, 21 bp, Homo sapiens
atagatgtacatattgtgtcg

SEQ ID NO: 45491 - DNA, 21 bp, Homo sapiens
atcattatttattgatgtgat

SEQ ID NO: 45492 - DNA, 21 bp, Homo sapiens
ctttgcaccagaaacatatca

SEQ ID NO: 45493 - DNA, 25 bp, Homo sapiens
ggcactttgcaccagaaacatatca

SEQ ID NO: 45494 - DNA, 20 bp, Homo sapiens
ttgaacctaacctgcatccc

SEQ ID NO: 45495 - DNA, 19 bp, Homo sapiens
tgtcagcaagcagatctga

SEQ ID NO: 45496 - DNA, 17 bp, Homo sapiens
aagtggatcctcttgga

SEQ ID NO: 45497 - DNA, 20 bp, Homo sapiens
tgttgtactcagtgcattta

SEQ ID NO: 45498 - DNA, 24 bp, Homo sapiens
taacatctttaatagcacagcaaa

SEQ ID NO: 45499 - DNA, 19 bp, Homo sapiens
tttcatggtatagtctttc

SEQ ID NO: 45500 - DNA, 22 bp, Homo sapiens
tagatgcacagcagtggaattg

SEQ ID NO: 45501 - DNA, 24 bp, Homo sapiens
tgttaccttccaaggacaatgtca

SEQ ID NO: 45502 - DNA, 25 bp, Homo sapiens
taggtggttgaagatattgaaattg

SEQ ID NO: 45503 - DNA, 21 bp, Homo sapiens
cagaaaagccaagactttaac

SEQ ID NO: 45504 - DNA, 23 bp, Homo sapiens
gtctgaggttgctggctaacttt

SEQ ID NO: 45505 - DNA, 22 bp, Homo sapiens
tatttcagagtaaaatctccta

SEQ ID NO: 45506 - DNA, 23 bp, Homo sapiens
gcctgggtttcctgccctggccc

SEQ ID NO: 45507 - DNA, 19 bp, Homo sapiens
aaacaagaaaatgatgtta

SEQ ID NO: 45508 - DNA, 22 bp, Homo sapiens
acagagaactggaatctcactt

SEQ ID NO: 45509 - DNA, 18 bp, Homo sapiens
agaaaaatcactgtgctg

SEQ ID NO: 45510 - DNA, 18 bp, Homo sapiens
cccagagattctacccag

SEQ ID NO: 45511 - DNA, 17 bp, Homo sapiens
cgcaaaagatgtacctg

SEQ ID NO: 45512 - DNA, 21 bp, Homo sapiens
ctttatggttcaataaatata

SEQ ID NO: 45513 - DNA, 22 bp, Homo sapiens
cccggctccctcgctctgcagg

SEQ ID NO: 45514 - DNA, 17 bp, Homo sapiens
gaggcggcggcggcggc

SEQ ID NO: 45515 - DNA, 22 bp, Homo sapiens
gcggaggaggaggaggcgccgc

SEQ ID NO: 45516 - DNA, 21 bp, Homo sapiens
acagccccgccaacagccaca

SEQ ID NO: 45517 - DNA, 18 bp, Homo sapiens
cccatagcccctttgcca

SEQ ID NO: 45518 - DNA, 18 bp, Homo sapiens
cctactgggccgctgcca

SEQ ID NO: 45519 - DNA, 23 bp, Homo sapiens
cctgcccccgagacccagcccca

SEQ ID NO: 45520 - DNA, 18 bp, Homo sapiens
cttctctccctcctcctc

SEQ ID NO: 45521 - DNA, 23 bp, Homo sapiens
tcctgacgtggcggagctgtgga

SEQ ID NO: 45522 - DNA, 21 bp, Homo sapiens
tgcatccgcagcgtggggctg

SEQ ID NO: 45523 - DNA, 22 bp, Homo sapiens
ccctggtgacaccttcctggag

SEQ ID NO: 45524 - DNA, 19 bp, Homo sapiens
gtccaaacccaggatctca

SEQ ID NO: 45525 - DNA, 20 bp, Homo sapiens
aaagttgcctgctctggcag

SEQ ID NO: 45526 - DNA, 15 bp, Homo sapiens
aggaaaagaaagcaa

SEQ ID NO: 45527 - DNA, 19 bp, Homo sapiens
cagcaggagccaagaggaa

SEQ ID NO: 45528 - DNA, 19 bp, Homo sapiens
cagtaccatctctgcctcc

SEQ ID NO: 45529 - DNA, 18 bp, Homo sapiens
ggagctttttaaatttca

SEQ ID NO: 45530 - DNA, 22 bp, Homo sapiens
ctgttctctttggtttggaata

SEQ ID NO: 45531 - DNA, 21 bp, Homo sapiens
gcctttcctccattttctgtg

SEQ ID NO: 45532 - DNA, 18 bp, Homo sapiens
ggagctttttaaatctca

SEQ ID NO: 45533 - DNA, 18 bp, Homo sapiens
tgagctcttccttagctc

SEQ ID NO: 45534 - DNA, 21 bp, Homo sapiens
ttgcccaaaactgttctcttt

SEQ ID NO: 45535 - DNA, 21 bp, Homo sapiens
gcctttcctccattttctgtg

SEQ ID NO: 45536 - DNA, 18 bp, Homo sapiens
ggagctttctaaatctca

SEQ ID NO: 45537 - DNA, 18 bp, Homo sapiens
tgagctcttctatagctc

SEQ ID NO: 45538 - DNA, 19 bp, Homo sapiens
tttttcttttttcatttca

SEQ ID NO: 45539 - DNA, 22 bp, Homo sapiens
cttgttgctgccccacactcca

SEQ ID NO: 45540 - DNA, 16 bp, Homo sapiens
gcctgagccgcctgct

SEQ ID NO: 45541 - DNA, 20 bp, Homo sapiens
ttcaagaccagcctgaccaa

SEQ ID NO: 45542 - DNA, 19 bp, Homo sapiens
gggtgatccacccgcctcc

SEQ ID NO: 45543 - DNA, 20 bp, Homo sapiens
tgcactccagcctgggactg

SEQ ID NO: 45544 - DNA, 21 bp, Homo sapiens
agtggctttgatttgggatta

SEQ ID NO: 45545 - DNA, 18 bp, Homo sapiens
ccagagcatcctcagtga

SEQ ID NO: 45546 - DNA, 17 bp, Homo sapiens
ggatcaggagacaggaa

SEQ ID NO: 45547 - DNA, 20 bp, Homo sapiens
tcatgagtagggcaatagac

SEQ ID NO: 45548 - DNA, 21 bp, Homo sapiens
tgagaggctggcatggatcta

SEQ ID NO: 45549 - DNA, 23 bp, Homo sapiens
ttcaggagattatatttcactca

SEQ ID NO: 45550 - DNA, 28 bp, Homo sapiens
atgctatttcttttttttttctcttgac

SEQ ID NO: 45551 - DNA, 20 bp, Homo sapiens
aatgtctagcatgggaacta

SEQ ID NO: 45552 - DNA, 21 bp, Homo sapiens
cagaactcctacattgcctgg

SEQ ID NO: 45553 - DNA, 16 bp, Homo sapiens
cctcattaagaccagt

SEQ ID NO: 45554 - DNA, 18 bp, Homo sapiens
actgacaagaagtgtgca

SEQ ID NO: 45555 - DNA, 20 bp, Homo sapiens
cctctgcctcccaggttcaa

SEQ ID NO: 45556 - DNA, 19 bp, Homo sapiens
gactgaggaaaactctcca

SEQ ID NO: 45557 - DNA, 19 bp, Homo sapiens
gtgatacagcaaaaagcca

SEQ ID NO: 45558 - DNA, 18 bp, Homo sapiens
ttctcctgcttcagcctt

SEQ ID NO: 45559 - DNA, 22 bp, Homo sapiens
aaggtcacctgcactcccagcc

SEQ ID NO: 45560 - DNA, 23 bp, Homo sapiens
acttgaggtctgacttttggctc

SEQ ID NO: 45561 - DNA, 21 bp, Homo sapiens
caacaagttcttgttgactca

SEQ ID NO: 45562 - DNA, 18 bp, Homo sapiens
gaggtctgacttttggct

SEQ ID NO: 45563 - DNA, 20 bp, Homo sapiens
gtaatctgttgacagtgcca

SEQ ID NO: 45564 - DNA, 19 bp, Homo sapiens
tcttcctctcttttgctca

SEQ ID NO: 45565 - DNA, 21 bp, Homo sapiens
tgggaactgatttgacctcga

SEQ ID NO: 45566 - DNA, 18 bp, Homo sapiens
ccgggcgagcctcggatt

SEQ ID NO: 45567 - DNA, 19 bp, Homo sapiens
cgcgcggccgtcgcacctg

SEQ ID NO: 45568 - DNA, 19 bp, Homo sapiens
ctgcaacctccgcctccca

SEQ ID NO: 45569 - DNA, 18 bp, Homo sapiens
tccgcctcccaggttcaa

SEQ ID NO: 45570 - DNA, 15 bp, Homo sapiens
gcaggattcctctct

SEQ ID NO: 45571 - DNA, 19 bp, Homo sapiens
cattcaagtcagctttcac

SEQ ID NO: 45572 - DNA, 24 bp, Homo sapiens
taaaatgcacagaattgcctgcag

SEQ ID NO: 45573 - DNA, 21 bp, Homo sapiens
aagactaggtgttatcctaca

SEQ ID NO: 45574 - DNA, 19 bp, Homo sapiens
acaaaagcatgatcattca

SEQ ID NO: 45575 - DNA, 21 bp, Homo sapiens
acttgaagcctgatctggcct

SEQ ID NO: 45576 - DNA, 19 bp, Homo sapiens
agttcccctagttactaca

SEQ ID NO: 45577 - DNA, 19 bp, Homo sapiens
attcccccaatggacaaga

SEQ ID NO: 45578 - DNA, 22 bp, Homo sapiens
attccctgcagaagccgcagca

SEQ ID NO: 45579 - DNA, 19 bp, Homo sapiens
ctacaagtatgctgggata

SEQ ID NO: 45580 - DNA, 21 bp, Homo sapiens
ggctcatctctgctgcagtaa

SEQ ID NO: 45581 - DNA, 19 bp, Homo sapiens
gggccgcccgctcgcctcc

SEQ ID NO: 45582 - DNA, 20 bp, Homo sapiens
tcatgcccaatctggaccaa

SEQ ID NO: 45583 - DNA, 17 bp, Homo sapiens
tgagccacaaaggctgg

SEQ ID NO: 45584 - DNA, 21 bp, Homo sapiens
tgatctcacccctgtacttca

SEQ ID NO: 45585 - DNA, 19 bp, Homo sapiens
ttgctgagagcaacttgca

SEQ ID NO: 45586 - DNA, 21 bp, Homo sapiens
aaacccgaaaccgttacatct

SEQ ID NO: 45587 - DNA, 18 bp, Homo sapiens
actctctggaagttctgg

SEQ ID NO: 45588 - DNA, 19 bp, Homo sapiens
agacatcacccacaagggg

SEQ ID NO: 45589 - DNA, 19 bp, Homo sapiens
cacactgattactcactca

SEQ ID NO: 45590 - DNA, 19 bp, Homo sapiens
cactcaccagcctccttct

SEQ ID NO: 45591 - DNA, 19 bp, Homo sapiens
gagccaggatgaaatgtca

SEQ ID NO: 45592 - DNA, 22 bp, Homo sapiens
ggagcgcctgacgggcccaaca

SEQ ID NO: 45593 - DNA, 21 bp, Homo sapiens
atcttactggttgttaggcct

SEQ ID NO: 45594 - DNA, 21 bp, Homo sapiens
gcctgaataggctcctggccc

SEQ ID NO: 45595 - DNA, 20 bp, Homo sapiens
gccccttgggggttcaggga

SEQ ID NO: 45596 - DNA, 20 bp, Homo sapiens
gccccttgggggttcaggga

SEQ ID NO: 45597 - DNA, 18 bp, Homo sapiens
ccgtgatcccatcccaga

SEQ ID NO: 45598 - DNA, 17 bp, Homo sapiens
aaaaacaaacaaacaaa

SEQ ID NO: 45599 - DNA, 16 bp, Homo sapiens
aggcatcaggttctgg

SEQ ID NO: 45600 - DNA, 16 bp, Homo sapiens
tcagcagcatctgctc

SEQ ID NO: 45601 - DNA, 20 bp, Homo sapiens
tgtctcatgccacattctcc

SEQ ID NO: 45602 - DNA, 20 bp, Homo sapiens
gtgtatgtgagcggggagct

SEQ ID NO: 45603 - DNA, 20 bp, Homo sapiens
ccacaacctcacgtaacctc

SEQ ID NO: 45604 - DNA, 23 bp, Homo sapiens
gggacgcagacggcggcggcggc

SEQ ID NO: 45605 - DNA, 18 bp, Homo sapiens
acctgactggagctcaga

SEQ ID NO: 45606 - DNA, 20 bp, Homo sapiens
aaaaaggaaaggttcttcca

SEQ ID NO: 45607 - DNA, 20 bp, Homo sapiens
acgcttacacctctgcctca

SEQ ID NO: 45608 - DNA, 21 bp, Homo sapiens
caaccctgaccttccccctcc

SEQ ID NO: 45609 - DNA, 19 bp, Homo sapiens
cactgcccacccctctttt

SEQ ID NO: 45610 - DNA, 24 bp, Homo sapiens
cttccattcccttaaattctgagt

SEQ ID NO: 45611 - DNA, 21 bp, Homo sapiens
ggactggtgcctttgcattca

SEQ ID NO: 45612 - DNA, 24 bp, Homo sapiens
ggtaagagataaacagtaaccctt

SEQ ID NO: 45613 - DNA, 19 bp, Homo sapiens
gtaactgacttcacacagt

SEQ ID NO: 45614 - DNA, 25 bp, Homo sapiens
tcaccaaccctgaccttccccctcc

SEQ ID NO: 45615 - DNA, 17 bp, Homo sapiens
ttcccttaaattctgag

SEQ ID NO: 45616 - DNA, 17 bp, Homo sapiens
aaccaaaggtttacttt

SEQ ID NO: 45617 - DNA, 18 bp, Homo sapiens
caagagcataggagtttt

SEQ ID NO: 45618 - DNA, 19 bp, Homo sapiens
catgagaactagaaaggaa

SEQ ID NO: 45619 - DNA, 22 bp, Homo sapiens
ccagattaaggtatttgtctaa

SEQ ID NO: 45620 - DNA, 24 bp, Homo sapiens
tagcctttccaaaggagacagtca

SEQ ID NO: 45621 - DNA, 17 bp, Homo sapiens
tctgtaattgctattgc

SEQ ID NO: 45622 - DNA, 18 bp, Homo sapiens
tgggtggatcacctgagg

SEQ ID NO: 45623 - DNA, 23 bp, Homo sapiens
ttgaatttttaaagtaaagctca

SEQ ID NO: 45624 - DNA, 24 bp, Homo sapiens
tttagtgtgcctggggtcactttt

SEQ ID NO: 45625 - DNA, 19 bp, Homo sapiens
tagtgtttgactactgcta

SEQ ID NO: 45626 - DNA, 25 bp, Homo sapiens
tcaccctcctgtcccccccacctcc

SEQ ID NO: 45627 - DNA, 19 bp, Homo sapiens
accattgagaatgcgcagc

SEQ ID NO: 45628 - DNA, 21 bp, Homo sapiens
acctcggtgaccgcctggcct

SEQ ID NO: 45629 - DNA, 20 bp, Homo sapiens
caccattgagaatgcgcagc

SEQ ID NO: 45630 - DNA, 17 bp, Homo sapiens
tccagagggtgttccag

SEQ ID NO: 45631 - DNA, 19 bp, Homo sapiens
acctgcaattttgtgcaca

SEQ ID NO: 45632 - DNA, 17 bp, Homo sapiens
cacatctattgtttcct

SEQ ID NO: 45633 - DNA, 23 bp, Homo sapiens
cagagacgtgggtacaaaccctg

SEQ ID NO: 45634 - DNA, 20 bp, Homo sapiens
ctgggatacactccaagtca

SEQ ID NO: 45635 - DNA, 22 bp, Homo sapiens
ctgtggatgttaaacctcgttt

SEQ ID NO: 45636 - DNA, 17 bp, Homo sapiens
acattttagagttctga

SEQ ID NO: 45637 - DNA, 18 bp, Homo sapiens
gtaaaagttttagccagc

SEQ ID NO: 45638 - DNA, 19 bp, Homo sapiens
caagagtcaacctggagca

SEQ ID NO: 45639 - DNA, 18 bp, Homo sapiens
ggaaaacagggtggccac

SEQ ID NO: 45640 - DNA, 19 bp, Homo sapiens
agaagtcgtggggggccca

SEQ ID NO: 45641 - DNA, 18 bp, Homo sapiens
ccaagtcatcctcccacc

SEQ ID NO: 45642 - DNA, 19 bp, Homo sapiens
agcagtgcaaaggccctga

SEQ ID NO: 45643 - DNA, 24 bp, Homo sapiens
cccagctcaagaaggcgctgcagg

SEQ ID NO: 45644 - DNA, 22 bp, Homo sapiens
cctgggccaccccacagcgggc

SEQ ID NO: 45645 - DNA, 19 bp, Homo sapiens
gtctcactctgtcgcccag

SEQ ID NO: 45646 - DNA, 16 bp, Homo sapiens
gtgggatggcgagtga

SEQ ID NO: 45647 - DNA, 19 bp, Homo sapiens
aggccactcagataacctt

SEQ ID NO: 45648 - DNA, 19 bp, Homo sapiens
catccctctcaggctcctt

SEQ ID NO: 45649 - DNA, 23 bp, Homo sapiens
gtaagagacaactgggtctgttt

SEQ ID NO: 45650 - DNA, 21 bp, Homo sapiens
taagagacaactgggtctgtt

SEQ ID NO: 45651 - DNA, 22 bp, Homo sapiens
gcacagccacagagagctcctc

SEQ ID NO: 45652 - DNA, 18 bp, Homo sapiens
gctgtgtctcccattcca

SEQ ID NO: 45653 - DNA, 23 bp, Homo sapiens
ggtgagcacagccacagagagct

SEQ ID NO: 45654 - DNA, 22 bp, Homo sapiens
ccaggggtcaccgtgtgcacca

SEQ ID NO: 45655 - DNA, 17 bp, Homo sapiens
ccccggatgtgctcagt

SEQ ID NO: 45656 - DNA, 22 bp, Homo sapiens
ctgatggctcaacccagtccca

SEQ ID NO: 45657 - DNA, 20 bp, Homo sapiens
gggctcttccagtcctgcag

SEQ ID NO: 45658 - DNA, 17 bp, Homo sapiens
ggcctacagttgtcgtt

SEQ ID NO: 45659 - DNA, 17 bp, Homo sapiens
gtgtggacttcaccctg

SEQ ID NO: 45660 - DNA, 16 bp, Homo sapiens
agaccagctaccgcga

SEQ ID NO: 45661 - DNA, 24 bp, Homo sapiens
gcctgaagggttctgctgtggtcc

SEQ ID NO: 45662 - DNA, 18 bp, Homo sapiens
tcacgtctgtgcactgtc

SEQ ID NO: 45663 - DNA, 18 bp, Homo sapiens
tgcaaaacacactggctc

SEQ ID NO: 45664 - DNA, 20 bp, Homo sapiens
tccatttgcaaaggttactt

SEQ ID NO: 45665 - DNA, 20 bp, Homo sapiens
aaacacatgctgtgtttgaa

SEQ ID NO: 45666 - DNA, 22 bp, Homo sapiens
cacctctaccaatccatcttca

SEQ ID NO: 45667 - DNA, 23 bp, Homo sapiens
cttacagattccaggtccctttt

SEQ ID NO: 45668 - DNA, 22 bp, Homo sapiens
ggacttagtttcatctattgta

SEQ ID NO: 45669 - DNA, 24 bp, Homo sapiens
gtttgaattgtggctgagaggttt

SEQ ID NO: 45670 - DNA, 18 bp, Homo sapiens
aaatcacccttaaatcaa

SEQ ID NO: 45671 - DNA, 21 bp, Homo sapiens
atatgatatattttctctaaa

SEQ ID NO: 45672 - DNA, 22 bp, Homo sapiens
atctcggaatggaaaaagatca

SEQ ID NO: 45673 - DNA, 23 bp, Homo sapiens
cctaggcaggcagactgagctca

SEQ ID NO: 45674 - DNA, 17 bp, Homo sapiens
ggttgcaataccaatct

SEQ ID NO: 45675 - DNA, 21 bp, Homo sapiens
acaaaagagagcatctcttct

SEQ ID NO: 45676 - DNA, 21 bp, Homo sapiens
agtgcccaactctataggctt

SEQ ID NO: 45677 - DNA, 18 bp, Homo sapiens
ctccccaccctctgcctc

SEQ ID NO: 45678 - DNA, 18 bp, Homo sapiens
gacagggaggacagggcc

SEQ ID NO: 45679 - DNA, 17 bp, Homo sapiens
tctcctctgcagcatga

SEQ ID NO: 45680 - DNA, 16 bp, Homo sapiens
tgccttggttggttta

SEQ ID NO: 45681 - DNA, 24 bp, Homo sapiens
acagaggggataacaacagcaata

SEQ ID NO: 45682 - DNA, 21 bp, Homo sapiens
caagcacaggttagagtccca

SEQ ID NO: 45683 - DNA, 18 bp, Homo sapiens
cccaccagctgacaggca

SEQ ID NO: 45684 - DNA, 22 bp, Homo sapiens
cggcctacagcccgtgctgctg

SEQ ID NO: 45685 - DNA, 22 bp, Homo sapiens
taaatggaaggaattggaactg

SEQ ID NO: 45686 - DNA, 17 bp, Homo sapiens
tcatgcaacatctggac

SEQ ID NO: 45687 - DNA, 21 bp, Homo sapiens
agcttatgcaacatgctcagc

SEQ ID NO: 45688 - DNA, 23 bp, Homo sapiens
caatacaggttcaccatcattaa

SEQ ID NO: 45689 - DNA, 19 bp, Homo sapiens
cactgctttccccaccagg

SEQ ID NO: 45690 - DNA, 20 bp, Homo sapiens
tcaccatcattaacagcaaa

SEQ ID NO: 45691 - DNA, 23 bp, Homo sapiens
gactaaaatcaaaattctgagaa

SEQ ID NO: 45692 - DNA, 19 bp, Homo sapiens
tcctggagaaactgcaggg

SEQ ID NO: 45693 - DNA, 21 bp, Homo sapiens
atccaggagtttctccttttt

SEQ ID NO: 45694 - DNA, 23 bp, Homo sapiens
catcgtatccaaaaggctctttt

SEQ ID NO: 45695 - DNA, 24 bp, Homo sapiens
aacttgaagatctcacagacctaa

SEQ ID NO: 45696 - DNA, 19 bp, Homo sapiens
accaagctacaattagaga

SEQ ID NO: 45697 - DNA, 17 bp, Homo sapiens
ctttcctctctgcctct

SEQ ID NO: 45698 - DNA, 22 bp, Homo sapiens
gattggagaatggtacaaactg

SEQ ID NO: 45699 - DNA, 19 bp, Homo sapiens
cccccaccccaacccccct

SEQ ID NO: 45700 - DNA, 18 bp, Homo sapiens
cgccgaaggctttggtga

SEQ ID NO: 45701 - DNA, 18 bp, Homo sapiens
ggagaggaggctgaggcc

SEQ ID NO: 45702 - DNA, 17 bp, Homo sapiens
aagcaagccctgctcac

SEQ ID NO: 45703 - DNA, 19 bp, Homo sapiens
tccaggtcccttgttccag

SEQ ID NO: 45704 - DNA, 21 bp, Homo sapiens
tcctggcttcagcaatgggct

SEQ ID NO: 45705 - DNA, 18 bp, Homo sapiens
tgccaactcactgtgatg

SEQ ID NO: 45706 - DNA, 22 bp, Homo sapiens
tgcctagggacaccttttccag

SEQ ID NO: 45707 - DNA, 19 bp, Homo sapiens
tttgggtgatctcttgtca

SEQ ID NO: 45708 - DNA, 20 bp, Homo sapiens
actcacagatccacacctga

SEQ ID NO: 45709 - DNA, 19 bp, Homo sapiens
gtccactggagggtccaga

SEQ ID NO: 45710 - DNA, 21 bp, Homo sapiens
tgtgcagctacctatctgctg

SEQ ID NO: 45711 - DNA, 22 bp, Homo sapiens
acatacctacccttttctacct

SEQ ID NO: 45712 - DNA, 18 bp, Homo sapiens
gtttctgttgcagagtta

SEQ ID NO: 45713 - DNA, 21 bp, Homo sapiens
tattatgctcttggtgtacca

SEQ ID NO: 45714 - DNA, 21 bp, Homo sapiens
caacattttccccatccctct

SEQ ID NO: 45715 - DNA, 22 bp, Homo sapiens
caccccacactcccacctcttt

SEQ ID NO: 45716 - DNA, 21 bp, Homo sapiens
ccaccccacactcccacctct

SEQ ID NO: 45717 - DNA, 19 bp, Homo sapiens
cccaaaatccacattctcc

SEQ ID NO: 45718 - DNA, 17 bp, Homo sapiens
cggcccctgtgatccca

SEQ ID NO: 45719 - DNA, 19 bp, Homo sapiens
tctaacctcacctcattct

SEQ ID NO: 45720 - DNA, 16 bp, Homo sapiens
tctggacaggagacac

SEQ ID NO: 45721 - DNA, 20 bp, Homo sapiens
agaagattatgttcttgtac

SEQ ID NO: 45722 - DNA, 16 bp, Homo sapiens
agcctcctactagtac

SEQ ID NO: 45723 - DNA, 21 bp, Homo sapiens
cactttgcagccctcatctca

SEQ ID NO: 45724 - DNA, 25 bp, Homo sapiens
cgggcagctgccaccccgcccggcc

SEQ ID NO: 45725 - DNA, 22 bp, Homo sapiens
gcgtcttttctctgtggactct

SEQ ID NO: 45726 - DNA, 20 bp, Homo sapiens
tggccccgcctcttgcccca

SEQ ID NO: 45727 - DNA, 17 bp, Homo sapiens
gcgcccgcctcgcctcc

SEQ ID NO: 45728 - DNA, 26 bp, Homo sapiens
acaccaggagaatggcttctccacca

SEQ ID NO: 45729 - DNA, 18 bp, Homo sapiens
caggagaatggcttctcc

SEQ ID NO: 45730 - DNA, 19 bp, Homo sapiens
cgccgctgagaccccgaga

SEQ ID NO: 45731 - DNA, 19 bp, Homo sapiens
gggaaaagcacttccagca

SEQ ID NO: 45732 - DNA, 24 bp, Homo sapiens
gcctttcttggctggcaacacaca

SEQ ID NO: 45733 - DNA, 16 bp, Homo sapiens
cacaaaaatgtcttcc

SEQ ID NO: 45734 - DNA, 17 bp, Homo sapiens
ccattggttagcacact

SEQ ID NO: 45735 - DNA, 20 bp, Homo sapiens
gagccaatcttggacctacc

SEQ ID NO: 45736 - DNA, 28 bp, Homo sapiens
gggcaaccagtcgtgaagacacgggaga

SEQ ID NO: 45737 - DNA, 21 bp, Homo sapiens
ctttgccttcgcagccgcctc

SEQ ID NO: 45738 - DNA, 20 bp, Homo sapiens
ccagtggcagcttttcctgt

SEQ ID NO: 45739 - DNA, 18 bp, Homo sapiens
ccagtggctgccttgtcc

SEQ ID NO: 45740 - DNA, 22 bp, Homo sapiens
ctttcttccaggcccttgactg

SEQ ID NO: 45741 - DNA, 20 bp, Homo sapiens
ccccacccccaccccgctgc

SEQ ID NO: 45742 - DNA, 23 bp, Homo sapiens
ctggtgattaattagcaattctc

SEQ ID NO: 45743 - DNA, 20 bp, Homo sapiens
gcctggattgctcactgttt

SEQ ID NO: 45744 - DNA, 22 bp, Homo sapiens
tctgagcgagcgcggtgctttt

SEQ ID NO: 45745 - DNA, 18 bp, Homo sapiens
actgcagtttctacctga

SEQ ID NO: 45746 - DNA, 22 bp, Homo sapiens
acttcatccgcaggattccagc

SEQ ID NO: 45747 - DNA, 19 bp, Homo sapiens
cccacccctgaccacctca

SEQ ID NO: 45748 - DNA, 22 bp, Homo sapiens
cctgccccccaccagcacctca

SEQ ID NO: 45749 - DNA, 23 bp, Homo sapiens
ctcagtgggggatactgcaagtt

SEQ ID NO: 45750 - DNA, 15 bp, Homo sapiens
cttctgccatgactg

SEQ ID NO: 45751 - DNA, 20 bp, Homo sapiens
ggcacacagcacttaggctg

SEQ ID NO: 45752 - DNA, 19 bp, Homo sapiens
caaccgccttgcatccagt

SEQ ID NO: 45753 - DNA, 22 bp, Homo sapiens
acatgacgcaggcttcacctct

SEQ ID NO: 45754 - DNA, 21 bp, Homo sapiens
gtcacagttaatgccagtgct

SEQ ID NO: 45755 - DNA, 17 bp, Homo sapiens
agacactcccactcgcc

SEQ ID NO: 45756 - DNA, 19 bp, Homo sapiens
gcacaggtggcagctggga

SEQ ID NO: 45757 - DNA, 19 bp, Homo sapiens
ctaagcggttccagtttgt

SEQ ID NO: 45758 - DNA, 19 bp, Homo sapiens
gtccacggatattttgatc

SEQ ID NO: 45759 - DNA, 19 bp, Homo sapiens
aaaccttttctcccctttc

SEQ ID NO: 45760 - DNA, 21 bp, Homo sapiens
acactgcagaaggaactggtt

SEQ ID NO: 45761 - DNA, 19 bp, Homo sapiens
agaggagaaataaaacctt

SEQ ID NO: 45762 - DNA, 18 bp, Homo sapiens
agcaccatctgttcccct

SEQ ID NO: 45763 - DNA, 21 bp, Homo sapiens
agccaagggagcagggtcatt

SEQ ID NO: 45764 - DNA, 18 bp, Homo sapiens
cacacaggcacccaccca

SEQ ID NO: 45765 - DNA, 19 bp, Homo sapiens
cattggtgtgtttagagat

SEQ ID NO: 45766 - DNA, 19 bp, Homo sapiens
ccagctatcctcgcactca

SEQ ID NO: 45767 - DNA, 20 bp, Homo sapiens
cctggcaccccacccactcc

SEQ ID NO: 45768 - DNA, 18 bp, Homo sapiens
ctcctgttgtttggcctt

SEQ ID NO: 45769 - DNA, 19 bp, Homo sapiens
gtgctgcgctcttgggccc

SEQ ID NO: 45770 - DNA, 23 bp, Homo sapiens
tgacggactcagcactcccgcct

SEQ ID NO: 45771 - DNA, 18 bp, Homo sapiens
tgctgctccctgctcctc

SEQ ID NO: 45772 - DNA, 16 bp, Homo sapiens
ttggatgctgccttac

SEQ ID NO: 45773 - DNA, 19 bp, Homo sapiens
agtgggtggggaggtggtg

SEQ ID NO: 45774 - DNA, 19 bp, Homo sapiens
agaacctctccatctcctc

SEQ ID NO: 45775 - DNA, 22 bp, Homo sapiens
agagcaacagtattcctcaatc

SEQ ID NO: 45776 - DNA, 22 bp, Homo sapiens
ccacaaagaacctctccatctc

SEQ ID NO: 45777 - DNA, 22 bp, Homo sapiens
cctaaaaactatgactgccttt

SEQ ID NO: 45778 - DNA, 21 bp, Homo sapiens
tgctattttttttaatttgac

SEQ ID NO: 45779 - DNA, 23 bp, Homo sapiens
acttgcgtggtggcccctggccc

SEQ ID NO: 45780 - DNA, 16 bp, Homo sapiens
agcaccgtctgctcct

SEQ ID NO: 45781 - DNA, 21 bp, Homo sapiens
gaggccttcagcccctcgctc

SEQ ID NO: 45782 - DNA, 16 bp, Homo sapiens
gcaccgtctgctcctc

SEQ ID NO: 45783 - DNA, 22 bp, Homo sapiens
gtgctgcgggcgagggccccgg

SEQ ID NO: 45784 - DNA, 22 bp, Homo sapiens
tctgagccctaggatttggccc

SEQ ID NO: 45785 - DNA, 22 bp, Homo sapiens
tcttttcgaagctgttaatttt

SEQ ID NO: 45786 - DNA, 18 bp, Homo sapiens
cctgtctccctctctgaa

SEQ ID NO: 45787 - DNA, 23 bp, Homo sapiens
taaaaaagctggtgggtgaaaga

SEQ ID NO: 45788 - DNA, 21 bp, Homo sapiens
tttcaataacgaagttgggca

SEQ ID NO: 45789 - DNA, 22 bp, Homo sapiens
tttccaaaaaccatgtctccca

SEQ ID NO: 45790 - DNA, 17 bp, Homo sapiens
aactttgcacgtctgcc

SEQ ID NO: 45791 - DNA, 23 bp, Homo sapiens
cccccaaccccagcccttccgta

SEQ ID NO: 45792 - DNA, 20 bp, Homo sapiens
gtttctcccttttgtgtatt

SEQ ID NO: 45793 - DNA, 20 bp, Homo sapiens
tctcttcatatatccaaaga

SEQ ID NO: 45794 - DNA, 21 bp, Homo sapiens
tctttgtatctgaactttgca

SEQ ID NO: 45795 - DNA, 16 bp, Homo sapiens
actgagcagcattaca

SEQ ID NO: 45796 - DNA, 20 bp, Homo sapiens
agtgaactatttgttcctgg

SEQ ID NO: 45797 - DNA, 22 bp, Homo sapiens
ctgagcagcattacactacaat

SEQ ID NO: 45798 - DNA, 20 bp, Homo sapiens
ggcctgaatcttccatttta

SEQ ID NO: 45799 - DNA, 22 bp, Homo sapiens
ggtaatagcatattacagctga

SEQ ID NO: 45800 - DNA, 19 bp, Homo sapiens
tggctaaaattaactttag

SEQ ID NO: 45801 - DNA, 18 bp, Homo sapiens
tggttattggagaacttt

SEQ ID NO: 45802 - DNA, 21 bp, Homo sapiens
aaaccaattgaaagcgtccca

SEQ ID NO: 45803 - DNA, 20 bp, Homo sapiens
taacactttgatctcattaa

SEQ ID NO: 45804 - DNA, 22 bp, Homo sapiens
actccagatgaaaaaaacttgc

SEQ ID NO: 45805 - DNA, 20 bp, Homo sapiens
gcctccgatcgctgtggttc

SEQ ID NO: 45806 - DNA, 23 bp, Homo sapiens
ggcagtatataaatggtgcttta

SEQ ID NO: 45807 - DNA, 19 bp, Homo sapiens
ctctgagtgcagggcctgc

SEQ ID NO: 45808 - DNA, 21 bp, Homo sapiens
gctgtaatacagttggcagtt

SEQ ID NO: 45809 - DNA, 18 bp, Homo sapiens
actggtgggctgcaggga

SEQ ID NO: 45810 - DNA, 21 bp, Homo sapiens
cagaagagggtgagtcctgga

SEQ ID NO: 45811 - DNA, 18 bp, Homo sapiens
ccgcaccgcctcacaacc

SEQ ID NO: 45812 - DNA, 18 bp, Homo sapiens
cctgcaacctccacctcc

SEQ ID NO: 45813 - DNA, 18 bp, Homo sapiens
cctgcttcccaaacccca

SEQ ID NO: 45814 - DNA, 17 bp, Homo sapiens
cgggctggaacacagca

SEQ ID NO: 45815 - DNA, 20 bp, Homo sapiens
gaatctccatgtcccatgaa

SEQ ID NO: 45816 - DNA, 18 bp, Homo sapiens
gagccccggttttcccat

SEQ ID NO: 45817 - DNA, 21 bp, Homo sapiens
gtgccaggtgctgggggctct

SEQ ID NO: 45818 - DNA, 20 bp, Homo sapiens
tactggtgggaagcactgtg

SEQ ID NO: 45819 - DNA, 18 bp, Homo sapiens
tccacctcccgggttcaa

SEQ ID NO: 45820 - DNA, 22 bp, Homo sapiens
tgcccagggctcccccacccag

SEQ ID NO: 45821 - DNA, 18 bp, Homo sapiens
catttccccaggccaagt

SEQ ID NO: 45822 - DNA, 19 bp, Homo sapiens
cctctctgggcctgtgcag

SEQ ID NO: 45823 - DNA, 21 bp, Homo sapiens
ccttggtaactgatggactca

SEQ ID NO: 45824 - DNA, 18 bp, Homo sapiens
gaccttagcatggggcta

SEQ ID NO: 45825 - DNA, 18 bp, Homo sapiens
gaccttagcatggggcta

SEQ ID NO: 45826 - DNA, 16 bp, Homo sapiens
gaggctgtttctcaca

SEQ ID NO: 45827 - DNA, 24 bp, Homo sapiens
aaagtgcaacaggcaattgaatcc

SEQ ID NO: 45828 - DNA, 23 bp, Homo sapiens
aatgttagactttttcatctgcc

SEQ ID NO: 45829 - DNA, 20 bp, Homo sapiens
accagcagcctattacaagc

SEQ ID NO: 45830 - DNA, 19 bp, Homo sapiens
actacagggattttgtcat

SEQ ID NO: 45831 - DNA, 22 bp, Homo sapiens
ccacttcttttttcctaaataa

SEQ ID NO: 45832 - DNA, 22 bp, Homo sapiens
gaaaaatcatctagtgtgtgac

SEQ ID NO: 45833 - DNA, 16 bp, Homo sapiens
gacatagtacatgtac

SEQ ID NO: 45834 - DNA, 23 bp, Homo sapiens
gcctttgtttatttaaacatgaa

SEQ ID NO: 45835 - DNA, 22 bp, Homo sapiens
ttgaatgatggaaatcttatta

SEQ ID NO: 45836 - DNA, 19 bp, Homo sapiens
tttgtttatttaaacatga

SEQ ID NO: 45837 - DNA, 18 bp, Homo sapiens
ccatctatacaaactata

SEQ ID NO: 45838 - DNA, 23 bp, Homo sapiens
tggcccatcaccaccatcaacta

SEQ ID NO: 45839 - DNA, 19 bp, Homo sapiens
aagcaattctcctgcctca

SEQ ID NO: 45840 - DNA, 19 bp, Homo sapiens
aataggcaatattaataca

SEQ ID NO: 45841 - DNA, 18 bp, Homo sapiens
agatcctaatctactgca

SEQ ID NO: 45842 - DNA, 24 bp, Homo sapiens
atgggccctgtttccagtgtgagg

SEQ ID NO: 45843 - DNA, 19 bp, Homo sapiens
ccatttcctctcagaagca

SEQ ID NO: 45844 - DNA, 22 bp, Homo sapiens
ccatttctctgaactccagtaa

SEQ ID NO: 45845 - DNA, 23 bp, Homo sapiens
cctctgtctcagcattgggactg

SEQ ID NO: 45846 - DNA, 19 bp, Homo sapiens
ctgcaacctctgcctccca

SEQ ID NO: 45847 - DNA, 21 bp, Homo sapiens
gagctctgtggaaacagaatc

SEQ ID NO: 45848 - DNA, 24 bp, Homo sapiens
tagaatctaaaaattcatgttgaa

SEQ ID NO: 45849 - DNA, 18 bp, Homo sapiens
tgagccacatcacagtat

SEQ ID NO: 45850 - DNA, 18 bp, Homo sapiens
ttataaatagtcatgata

SEQ ID NO: 45851 - DNA, 19 bp, Homo sapiens
ttggatttataccaacaaa

SEQ ID NO: 45852 - DNA, 20 bp, Homo sapiens
gaatttattagtggaggatg

SEQ ID NO: 45853 - DNA, 17 bp, Homo sapiens
aaaaacaaacaaacaaa

SEQ ID NO: 45854 - DNA, 17 bp, Homo sapiens
accctacttattcttca

SEQ ID NO: 45855 - DNA, 24 bp, Homo sapiens
ttatctcccatgcatcctttctca

SEQ ID NO: 45856 - DNA, 17 bp, Homo sapiens
ttcaaagtcagatgaca

SEQ ID NO: 45857 - DNA, 19 bp, Homo sapiens
ttccagagacctatctcag

SEQ ID NO: 45858 - DNA, 19 bp, Homo sapiens
aagaaactttttttccttc

SEQ ID NO: 45859 - DNA, 22 bp, Homo sapiens
agttttaaatacatggaaggaa

SEQ ID NO: 45860 - DNA, 20 bp, Homo sapiens
atcggcagcttgacacccac

SEQ ID NO: 45861 - DNA, 19 bp, Homo sapiens
gcgcgccggccgcgctctg

SEQ ID NO: 45862 - DNA, 18 bp, Homo sapiens
tctgctgatatttgtgga

SEQ ID NO: 45863 - DNA, 18 bp, Homo sapiens
cttttccctttaggcctg

SEQ ID NO: 45864 - DNA, 20 bp, Homo sapiens
gactttggattccttgacca

SEQ ID NO: 45865 - DNA, 21 bp, Homo sapiens
gcgaagatggtctcgatctcc

SEQ ID NO: 45866 - DNA, 23 bp, Homo sapiens
gcttgagccactgcgcccggcct

SEQ ID NO: 45867 - DNA, 21 bp, Homo sapiens
gctttttactggtttatactg

SEQ ID NO: 45868 - DNA, 20 bp, Homo sapiens
tggtcaggctggtcttgaac

SEQ ID NO: 45869 - DNA, 23 bp, Homo sapiens
ttaaaacactccagttacttttc

SEQ ID NO: 45870 - DNA, 23 bp, Homo sapiens
ggcaaatgttaaaacacacttta

SEQ ID NO: 45871 - DNA, 20 bp, Homo sapiens
acaaaacagaacaagtctca

SEQ ID NO: 45872 - DNA, 24 bp, Homo sapiens
cacttggttttaataaattactca

SEQ ID NO: 45873 - DNA, 20 bp, Homo sapiens
ctgttatatactcagtgcaa

SEQ ID NO: 45874 - DNA, 17 bp, Homo sapiens
gtcatctaaaagctttt

SEQ ID NO: 45875 - DNA, 20 bp, Homo sapiens
tcagatgtgtttggtaatca

SEQ ID NO: 45876 - DNA, 19 bp, Homo sapiens
tgaacataagttcatttcc

SEQ ID NO: 45877 - DNA, 19 bp, Homo sapiens
acttcatcaaagatttgct

SEQ ID NO: 45878 - DNA, 18 bp, Homo sapiens
cagaaaaggttacacatg

SEQ ID NO: 45879 - DNA, 21 bp, Homo sapiens
gcgcctgggccggcgggtctt

SEQ ID NO: 45880 - DNA, 16 bp, Homo sapiens
tcttcagtatttgctt

SEQ ID NO: 45881 - DNA, 17 bp, Homo sapiens
ttgctcgtgtctgttga

SEQ ID NO: 45882 - DNA, 25 bp, Homo sapiens
tttggaaatggctgtttttaatttt

SEQ ID NO: 45883 - DNA, 21 bp, Homo sapiens
cacgtggccaaggccccgcag

SEQ ID NO: 45884 - DNA, 19 bp, Homo sapiens
tcagtgttttgccaattaa

SEQ ID NO: 45885 - DNA, 23 bp, Homo sapiens
ttgaattccatggttaaatctca

SEQ ID NO: 45886 - DNA, 25 bp, Homo sapiens
gcccccgacgccgccgagcacgtca

SEQ ID NO: 45887 - DNA, 21 bp, Homo sapiens
aggcacagctccatcattaca

SEQ ID NO: 45888 - DNA, 22 bp, Homo sapiens
ccaccagtcccagaacccgcca

SEQ ID NO: 45889 - DNA, 18 bp, Homo sapiens
cggttcctggagctgggc

SEQ ID NO: 45890 - DNA, 17 bp, Homo sapiens
ctgcctcacaacaacct

SEQ ID NO: 45891 - DNA, 18 bp, Homo sapiens
ggcacagctcctccctca

SEQ ID NO: 45892 - DNA, 19 bp, Homo sapiens
taagtggattccagagggg

SEQ ID NO: 45893 - DNA, 20 bp, Homo sapiens
aataaaattcccaacagctt

SEQ ID NO: 45894 - DNA, 19 bp, Homo sapiens
ataatcatatatacgtgta

SEQ ID NO: 45895 - DNA, 25 bp, Homo sapiens
atatatttgctgctgtgacatttca

SEQ ID NO: 45896 - DNA, 21 bp, Homo sapiens
caaaacattttcagtttatca

SEQ ID NO: 45897 - DNA, 17 bp, Homo sapiens
gagtaattgtcaagtga

SEQ ID NO: 45898 - DNA, 20 bp, Homo sapiens
gtgtctatatacacacgtgg

SEQ ID NO: 45899 - DNA, 17 bp, Homo sapiens
taatcatatatacgtgt

SEQ ID NO: 45900 - DNA, 24 bp, Homo sapiens
tctacaaagaaaaccagcataaaa

SEQ ID NO: 45901 - DNA, 18 bp, Homo sapiens
ttcccaacagcttccact

SEQ ID NO: 45902 - DNA, 22 bp, Homo sapiens
ttttgaccatggactttgtgga

SEQ ID NO: 45903 - DNA, 22 bp, Homo sapiens
agtgatgaccaaaagaaccaga

SEQ ID NO: 45904 - DNA, 19 bp, Homo sapiens
taatatctgactggcctcc

SEQ ID NO: 45905 - DNA, 18 bp, Homo sapiens
gagttgcgacgggcgtcg

SEQ ID NO: 45906 - DNA, 20 bp, Homo sapiens
tctgctggagtcctgatggg

SEQ ID NO: 45907 - DNA, 17 bp, Homo sapiens
agaaatgaaccaccgca

SEQ ID NO: 45908 - DNA, 19 bp, Homo sapiens
agaaaactgtaattttaaa

SEQ ID NO: 45909 - DNA, 27 bp, Homo sapiens
cctaatttgtttttccaaatcattttt

SEQ ID NO: 45910 - DNA, 17 bp, Homo sapiens
tttatagatgcagcacc

SEQ ID NO: 45911 - DNA, 21 bp, Homo sapiens
atctgaatcagaagtttgctc

SEQ ID NO: 45912 - DNA, 23 bp, Homo sapiens
gcaacttagcgaagctgccggtg

SEQ ID NO: 45913 - DNA, 26 bp, Homo sapiens
taggtgggaatatggttgtgggatta

SEQ ID NO: 45914 - DNA, 20 bp, Homo sapiens
caaaatgacattttgccaaa

SEQ ID NO: 45915 - DNA, 17 bp, Homo sapiens
gtccccctagagactca

SEQ ID NO: 45916 - DNA, 19 bp, Homo sapiens
aagcagtactggcataaaa

SEQ ID NO: 45917 - DNA, 17 bp, Homo sapiens
aaggggccgtggaagct

SEQ ID NO: 45918 - DNA, 21 bp, Homo sapiens
atggtgttgagtggcatgctc

SEQ ID NO: 45919 - DNA, 24 bp, Homo sapiens
caaaatagtagtaacaaatatata

SEQ ID NO: 45920 - DNA, 21 bp, Homo sapiens
ccttggctaaaggtctgggga

SEQ ID NO: 45921 - DNA, 21 bp, Homo sapiens
ccttggctaaaggtctgggga

SEQ ID NO: 45922 - DNA, 21 bp, Homo sapiens
tttgcctttgcgaaccatttc

SEQ ID NO: 45923 - DNA, 18 bp, Homo sapiens
agaaaacaaaactggcaa

SEQ ID NO: 45924 - DNA, 19 bp, Homo sapiens
atgtacttatggtaagcta

SEQ ID NO: 45925 - DNA, 21 bp, Homo sapiens
cagagttggggcattgaggaa

SEQ ID NO: 45926 - DNA, 21 bp, Homo sapiens
ctctttctctccctcctcctc

SEQ ID NO: 45927 - DNA, 22 bp, Homo sapiens
gaattcagtgaatattcattaa

SEQ ID NO: 45928 - DNA, 19 bp, Homo sapiens
ggaatgagcctgctgtggc

SEQ ID NO: 45929 - DNA, 17 bp, Homo sapiens
tccagaaatgctgtcca

SEQ ID NO: 45930 - DNA, 19 bp, Homo sapiens
taaagaatatttcccatgc

SEQ ID NO: 45931 - DNA, 22 bp, Homo sapiens
gacgctgtggctcacacctgta

SEQ ID NO: 45932 - DNA, 20 bp, Homo sapiens
aaacacatgctgtgtttgaa

SEQ ID NO: 45933 - DNA, 22 bp, Homo sapiens
cacctctaccaatccatcttca

SEQ ID NO: 45934 - DNA, 23 bp, Homo sapiens
cttacagattccaggtccctttt

SEQ ID NO: 45935 - DNA, 22 bp, Homo sapiens
ggacttagtttcatctattgta

SEQ ID NO: 45936 - DNA, 24 bp, Homo sapiens
gtttgaattgtggctgagaggttt

SEQ ID NO: 45937 - DNA, 18 bp, Homo sapiens
tagctgtctccagtctga

SEQ ID NO: 45938 - DNA, 20 bp, Homo sapiens
gaccctccagcagctgggca

SEQ ID NO: 45939 - DNA, 19 bp, Homo sapiens
tttgaggtggggcctggag

SEQ ID NO: 45940 - DNA, 23 bp, Homo sapiens
ctcccccagctgcagtggtccca

SEQ ID NO: 45941 - DNA, 19 bp, Homo sapiens
gctctggcccagggtggca

SEQ ID NO: 45942 - DNA, 17 bp, Homo sapiens
cctccctacttgctgct

SEQ ID NO: 45943 - DNA, 21 bp, Homo sapiens
tgctgtcatataatcattcca

SEQ ID NO: 45944 - DNA, 19 bp, Homo sapiens
accacatttaaacactgtt

SEQ ID NO: 45945 - DNA, 24 bp, Homo sapiens
cagaagaattgaggatctgatgga

SEQ ID NO: 45946 - DNA, 22 bp, Homo sapiens
gcatcaaatgtacattatttca

SEQ ID NO: 45947 - DNA, 17 bp, Homo sapiens
ggcggtcgagctgggcc

SEQ ID NO: 45948 - DNA, 20 bp, Homo sapiens
aggagggcgagtggcgagca

SEQ ID NO: 45949 - DNA, 23 bp, Homo sapiens
acagagaagaggagaccccaaca

SEQ ID NO: 45950 - DNA, 19 bp, Homo sapiens
ttctggatcccagcagtgt

SEQ ID NO: 45951 - DNA, 20 bp, Homo sapiens
ccagtggcaatgctttgtta

SEQ ID NO: 45952 - DNA, 19 bp, Homo sapiens
acctcatagtatgaaatta

SEQ ID NO: 45953 - DNA, 23 bp, Homo sapiens
acagagaagaggagaccccaaca

SEQ ID NO: 45954 - DNA, 19 bp, Homo sapiens
ttctggatcccagcagtgt

SEQ ID NO: 45955 - DNA, 20 bp, Homo sapiens
ctcctcgggcacacggtgaa

SEQ ID NO: 45956 - DNA, 20 bp, Homo sapiens
gggctaggctgggccgggtt

SEQ ID NO: 45957 - DNA, 20 bp, Homo sapiens
aattgaatctggatacatct

SEQ ID NO: 45958 - DNA, 18 bp, Homo sapiens
ctctgggagataatacac

SEQ ID NO: 45959 - DNA, 20 bp, Homo sapiens
cttgggagaggaattatttt

SEQ ID NO: 45960 - DNA, 19 bp, Homo sapiens
ccttcccagtttctcccca

SEQ ID NO: 45961 - DNA, 21 bp, Homo sapiens
cttccttgatctattatgact

SEQ ID NO: 45962 - DNA, 19 bp, Homo sapiens
ctttgactgttttagcttt

SEQ ID NO: 45963 - DNA, 23 bp, Homo sapiens
atgccttagcttcctcccgccgc

SEQ ID NO: 45964 - DNA, 18 bp, Homo sapiens
tggaaatgcctgccccag

SEQ ID NO: 45965 - DNA, 18 bp, Homo sapiens
tggaaatgcctgccccag

SEQ ID NO: 45966 - DNA, 21 bp, Homo sapiens
accctgaactccccatgtgat

SEQ ID NO: 45967 - DNA, 19 bp, Homo sapiens
cacatcacgttcagtgttt

SEQ ID NO: 45968 - DNA, 18 bp, Homo sapiens
gtgtgttcgtactccagg

SEQ ID NO: 45969 - DNA, 25 bp, Homo sapiens
tgtggggattaaagtgctgcgggtg

SEQ ID NO: 45970 - DNA, 22 bp, Homo sapiens
acccagagagaaaaagcatccc

SEQ ID NO: 45971 - DNA, 18 bp, Homo sapiens
ctcacagttaggctttta

SEQ ID NO: 45972 - DNA, 18 bp, Homo sapiens
ggagccgtcttttactca

SEQ ID NO: 45973 - DNA, 18 bp, Homo sapiens
tgcccacttctcatctct

SEQ ID NO: 45974 - DNA, 16 bp, Homo sapiens
ttcctgtgcctccctc

SEQ ID NO: 45975 - DNA, 21 bp, Homo sapiens
aacacaatggttcttactgtt

SEQ ID NO: 45976 - DNA, 17 bp, Homo sapiens
aggaaggaaaaaagcaa

SEQ ID NO: 45977 - DNA, 17 bp, Homo sapiens
ctgctttgcctactctc

SEQ ID NO: 45978 - DNA, 18 bp, Homo sapiens
tcaaaaacaattgagcat

SEQ ID NO: 45979 - DNA, 23 bp, Homo sapiens
tggtctcaaactcctgggttcaa

SEQ ID NO: 45980 - DNA, 19 bp, Homo sapiens
tgtcatcatcaattccatt

SEQ ID NO: 45981 - DNA, 19 bp, Homo sapiens
cgaagtgtcaggcgcgtct

SEQ ID NO: 45982 - DNA, 16 bp, Homo sapiens
gatgactaacacaact

SEQ ID NO: 45983 - DNA, 24 bp, Homo sapiens
taaaataagagctgtagctaccaa

SEQ ID NO: 45984 - DNA, 19 bp, Homo sapiens
gcggcggctggaacaatca

SEQ ID NO: 45985 - DNA, 23 bp, Homo sapiens
tggcaaagcaaccttaagctcta

SEQ ID NO: 45986 - DNA, 19 bp, Homo sapiens
cacaagtgaggatacgtaa

SEQ ID NO: 45987 - DNA, 21 bp, Homo sapiens
gaaacccttttctgtcgcgtc

SEQ ID NO: 45988 - DNA, 18 bp, Homo sapiens
acccatggcatggagctg

SEQ ID NO: 45989 - DNA, 16 bp, Homo sapiens
tgactgctgcaagtga

SEQ ID NO: 45990 - DNA, 22 bp, Homo sapiens
tggcttcccccagcgtgagact

SEQ ID NO: 45991 - DNA, 25 bp, Homo sapiens
acccagaatcaccactgccactttt

SEQ ID NO: 45992 - DNA, 19 bp, Homo sapiens
agtacaatattgccgatgc

SEQ ID NO: 45993 - DNA, 17 bp, Homo sapiens
ataaaatcagccactct

SEQ ID NO: 45994 - DNA, 16 bp, Homo sapiens
tggtttgagaacttta

SEQ ID NO: 45995 - DNA, 20 bp, Homo sapiens
gtcctttaaaacagaatgga

SEQ ID NO: 45996 - DNA, 22 bp, Homo sapiens
agcttttctacctgtccctgta

SEQ ID NO: 45997 - DNA, 24 bp, Homo sapiens
caggtgtggggctgggcatggtca

SEQ ID NO: 45998 - DNA, 22 bp, Homo sapiens
agcttttctacctgtccctgta

SEQ ID NO: 45999 - DNA, 24 bp, Homo sapiens
caggtgtggggctgggcatggtca

SEQ ID NO: 46000 - DNA, 18 bp, Homo sapiens
ggaagtgtcatcatagta

SEQ ID NO: 46001 - DNA, 18 bp, Homo sapiens
gtaaacagaaaactgcac

SEQ ID NO: 46002 - DNA, 19 bp, Homo sapiens
cctgggagctccacacaaa

SEQ ID NO: 46003 - DNA, 17 bp, Homo sapiens
ctcaacaatggtctttt

SEQ ID NO: 46004 - DNA, 21 bp, Homo sapiens
gctctgaggatccggcctcac

SEQ ID NO: 46005 - DNA, 21 bp, Homo sapiens
gctctgaggatccggcctcac

SEQ ID NO: 46006 - DNA, 18 bp, Homo sapiens
aactccctcatctgagaa

SEQ ID NO: 46007 - DNA, 16 bp, Homo sapiens
agagattgtcattccc

SEQ ID NO: 46008 - DNA, 16 bp, Homo sapiens
agccctgcttcccgca

SEQ ID NO: 46009 - DNA, 17 bp, Homo sapiens
agggacattttatctca

SEQ ID NO: 46010 - DNA, 18 bp, Homo sapiens
attccagagttcattcca

SEQ ID NO: 46011 - DNA, 22 bp, Homo sapiens
attgtcttaattccctaacgaa

SEQ ID NO: 46012 - DNA, 18 bp, Homo sapiens
cagcagagttaccactga

SEQ ID NO: 46013 - DNA, 21 bp, Homo sapiens
tcagcaggaaatcaatgtgga

SEQ ID NO: 46014 - DNA, 17 bp, Homo sapiens
tttcctgatagctgcag

SEQ ID NO: 46015 - DNA, 22 bp, Homo sapiens
cgggcgcatcacgaggtcagga

SEQ ID NO: 46016 - DNA, 20 bp, Homo sapiens
taagggttgacaccattctc

SEQ ID NO: 46017 - DNA, 21 bp, Homo sapiens
aacatccccccacctccattt

SEQ ID NO: 46018 - DNA, 20 bp, Homo sapiens
agctaccatgcaggccacag

SEQ ID NO: 46019 - DNA, 18 bp, Homo sapiens
atccgatcctccccttcc

SEQ ID NO: 46020 - DNA, 18 bp, Homo sapiens
cctgtaccacccactcca

SEQ ID NO: 46021 - DNA, 17 bp, Homo sapiens
aaacactgaaaaacatc

SEQ ID NO: 46022 - DNA, 18 bp, Homo sapiens
gtggatggaaaagttgtg

SEQ ID NO: 46023 - DNA, 21 bp, Homo sapiens
tggatggaaaagttgtggaac

SEQ ID NO: 46024 - DNA, 18 bp, Homo sapiens
aactagagtcagaacgaa

SEQ ID NO: 46025 - DNA, 20 bp, Homo sapiens
cctatctgtttgctgtgata

SEQ ID NO: 46026 - DNA, 18 bp, Homo sapiens
gcctattaagaggctttt

SEQ ID NO: 46027 - DNA, 17 bp, Homo sapiens
aggtagcctgaactttg

SEQ ID NO: 46028 - DNA, 19 bp, Homo sapiens
cagatgttgaatcctctaa

SEQ ID NO: 46029 - DNA, 19 bp, Homo sapiens
tcacctatctgagccacaa

SEQ ID NO: 46030 - DNA, 22 bp, Homo sapiens
caaactagctaaaggaaaccaa

SEQ ID NO: 46031 - DNA, 28 bp, Homo sapiens
gcctaaatgctttagttttaggtcattt

SEQ ID NO: 46032 - DNA, 20 bp, Homo sapiens
gctcatttcaggaaaaccta

SEQ ID NO: 46033 - DNA, 24 bp, Homo sapiens
gtagctttaacaacttttctgtta

SEQ ID NO: 46034 - DNA, 23 bp, Homo sapiens
taagaactggagcaagtactctt

SEQ ID NO: 46035 - DNA, 16 bp, Homo sapiens
tgaactttgtttccca

SEQ ID NO: 46036 - DNA, 23 bp, Homo sapiens
tttctttatagagaaagtacctt

SEQ ID NO: 46037 - DNA, 19 bp, Homo sapiens
attgacaagcccttctgat

SEQ ID NO: 46038 - DNA, 20 bp, Homo sapiens
gcatctacaccgttacctca

SEQ ID NO: 46039 - DNA, 21 bp, Homo sapiens
tcatcaccagcgactgctgta

SEQ ID NO: 46040 - DNA, 21 bp, Homo sapiens
ccgtgtctgacaaagactctg

SEQ ID NO: 46041 - DNA, 22 bp, Homo sapiens
gagttcacagaaacagatgcca

SEQ ID NO: 46042 - DNA, 22 bp, Homo sapiens
ttcaagtggtgctgaatcctca

SEQ ID NO: 46043 - DNA, 18 bp, Homo sapiens
cagcagacccccatcata

SEQ ID NO: 46044 - DNA, 17 bp, Homo sapiens
agttttgaaacagttac

SEQ ID NO: 46045 - DNA, 18 bp, Homo sapiens
caaccccacaaagtgaca

SEQ ID NO: 46046 - DNA, 19 bp, Homo sapiens
gctggtcaagcacgtgaca

SEQ ID NO: 46047 - DNA, 22 bp, Homo sapiens
atgtcaccaatgtactcgccca

SEQ ID NO: 46048 - DNA, 21 bp, Homo sapiens
gtggaaggagccagggtggca

SEQ ID NO: 46049 - DNA, 21 bp, Homo sapiens
attgcaccaagttctgtgaca

SEQ ID NO: 46050 - DNA, 17 bp, Homo sapiens
ccaactccggcaccttc

SEQ ID NO: 46051 - DNA, 21 bp, Homo sapiens
ccccggtccccgcagccagga

SEQ ID NO: 46052 - DNA, 19 bp, Homo sapiens
cgcgcggcggggtccctgc

SEQ ID NO: 46053 - DNA, 19 bp, Homo sapiens
gaccttccaacctccccca

SEQ ID NO: 46054 - DNA, 18 bp, Homo sapiens
acttagtgtgtgcagaga

SEQ ID NO: 46055 - DNA, 21 bp, Homo sapiens
accatatttctccccactctg

SEQ ID NO: 46056 - DNA, 21 bp, Homo sapiens
atgtggagcagggccacgtga

SEQ ID NO: 46057 - DNA, 23 bp, Homo sapiens
caaacagacctcctgcccatcca

SEQ ID NO: 46058 - DNA, 18 bp, Homo sapiens
gcagcacagggctgcatc

SEQ ID NO: 46059 - DNA, 17 bp, Homo sapiens
gcccagagtccgtccag

SEQ ID NO: 46060 - DNA, 23 bp, Homo sapiens
tcctgatggctaatgcctctgag

SEQ ID NO: 46061 - DNA, 24 bp, Homo sapiens
tgagcactgacccacagcactaca

SEQ ID NO: 46062 - DNA, 18 bp, Homo sapiens
ttcctagtgaccatccag

SEQ ID NO: 46063 - DNA, 20 bp, Homo sapiens
tttccatgtcacagctccac

SEQ ID NO: 46064 - DNA, 21 bp, Homo sapiens
tgggtgggcctgtcctggggc

SEQ ID NO: 46065 - DNA, 25 bp, Homo sapiens
cctccagaccctatcaacagcctca

SEQ ID NO: 46066 - DNA, 19 bp, Homo sapiens
tctgacctggaacagcagt

SEQ ID NO: 46067 - DNA, 21 bp, Homo sapiens
atcaaagtcttgggcatcgtg

SEQ ID NO: 46068 - DNA, 18 bp, Homo sapiens
gcagcgagagaacatatc

SEQ ID NO: 46069 - DNA, 20 bp, Homo sapiens
agacaacagattataagcta

SEQ ID NO: 46070 - DNA, 18 bp, Homo sapiens
cggcaagcagcccctgga

SEQ ID NO: 46071 - DNA, 20 bp, Homo sapiens
aagccgacccatctcccctc

SEQ ID NO: 46072 - DNA, 22 bp, Homo sapiens
cagctctgaattaccaacgctg

SEQ ID NO: 46073 - DNA, 17 bp, Homo sapiens
gaaaacatgccggaagc

SEQ ID NO: 46074 - DNA, 22 bp, Homo sapiens
tttcaaaaaggtctccgactcc

SEQ ID NO: 46075 - DNA, 21 bp, Homo sapiens
tgcccagaacttaggcctcca

SEQ ID NO: 46076 - DNA, 24 bp, Homo sapiens
tgagaaagatggctacacacacct

SEQ ID NO: 46077 - DNA, 19 bp, Homo sapiens
caccttcttcagagactca

SEQ ID NO: 46078 - DNA, 19 bp, Homo sapiens
tgaggctatatctgcactt

SEQ ID NO: 46079 - DNA, 24 bp, Homo sapiens
aatgctgcaacttttttacaccta

SEQ ID NO: 46080 - DNA, 24 bp, Homo sapiens
ttgtactttactactacagcatta

SEQ ID NO: 46081 - DNA, 19 bp, Homo sapiens
aaaaccaggcgcaaacaaa

SEQ ID NO: 46082 - DNA, 19 bp, Homo sapiens
cggcttcgaaagcttcgca

SEQ ID NO: 46083 - DNA, 18 bp, Homo sapiens
cctggttgggcggccctg

SEQ ID NO: 46084 - DNA, 19 bp, Homo sapiens
gcctaggcatcttcttata

SEQ ID NO: 46085 - DNA, 20 bp, Homo sapiens
cacctcccttccctttttta

SEQ ID NO: 46086 - DNA, 21 bp, Homo sapiens
cacctcccttcctttttttca

SEQ ID NO: 46087 - DNA, 23 bp, Homo sapiens
ggcgtgagccaccgcgcccggcc

SEQ ID NO: 46088 - DNA, 27 bp, Homo sapiens
tctgggcagtaaacctagctcattttt

SEQ ID NO: 46089 - DNA, 19 bp, Homo sapiens
tgccattttgataatgcta

SEQ ID NO: 46090 - DNA, 21 bp, Homo sapiens
tttgacccgtgggacttgtgg

SEQ ID NO: 46091 - DNA, 21 bp, Homo sapiens
agccccagctgctcctcctca

SEQ ID NO: 46092 - DNA, 22 bp, Homo sapiens
agctcatgtccaccgagcctct

SEQ ID NO: 46093 - DNA, 20 bp, Homo sapiens
agggcgagcagaaggcttgc

SEQ ID NO: 46094 - DNA, 24 bp, Homo sapiens
caagaagatggaggaggtggaagc

SEQ ID NO: 46095 - DNA, 23 bp, Homo sapiens
cacgtaggctcaggtggctgcag

SEQ ID NO: 46096 - DNA, 21 bp, Homo sapiens
tccatcacagtgagctccctg

SEQ ID NO: 46097 - DNA, 19 bp, Homo sapiens
actggtggcaggctgtggc

SEQ ID NO: 46098 - DNA, 18 bp, Homo sapiens
gcctcagccgcctcactc

SEQ ID NO: 46099 - DNA, 20 bp, Homo sapiens
gtgggcagcaccctgaacaa

SEQ ID NO: 46100 - DNA, 20 bp, Homo sapiens
atgaggagaccctgaacaca

SEQ ID NO: 46101 - DNA, 18 bp, Homo sapiens
aaccttttgaatacaatg

SEQ ID NO: 46102 - DNA, 20 bp, Homo sapiens
acctcattaaacatcagaga

SEQ ID NO: 46103 - DNA, 21 bp, Homo sapiens
atcagagaacacacgtgggga

SEQ ID NO: 46104 - DNA, 24 bp, Homo sapiens
ccttactaaacatctaagaacaca

SEQ ID NO: 46105 - DNA, 21 bp, Homo sapiens
ctatgataatgattcttctgg

SEQ ID NO: 46106 - DNA, 25 bp, Homo sapiens
cttgatttttgctcgaattgctttt

SEQ ID NO: 46107 - DNA, 21 bp, Homo sapiens
gcttaagaaaagatcattaca

SEQ ID NO: 46108 - DNA, 19 bp, Homo sapiens
ccgcagggtaaccttgtct

SEQ ID NO: 46109 - DNA, 22 bp, Homo sapiens
ctccaaattcctcctctgcgtc

SEQ ID NO: 46110 - DNA, 20 bp, Homo sapiens
tggtgccattgcctcagcca

SEQ ID NO: 46111 - DNA, 19 bp, Homo sapiens
ccgcagggtaaccttgtct

SEQ ID NO: 46112 - DNA, 22 bp, Homo sapiens
ctccaaattcctcctctgcgtc

SEQ ID NO: 46113 - DNA, 19 bp, Homo sapiens
agatctgaagatacgcccc

SEQ ID NO: 46114 - DNA, 17 bp, Homo sapiens
gaattcaacacaacacg

SEQ ID NO: 46115 - DNA, 19 bp, Homo sapiens
acttcagacacacaccaca

SEQ ID NO: 46116 - DNA, 22 bp, Homo sapiens
acttccgggttggccttctcca

SEQ ID NO: 46117 - DNA, 21 bp, Homo sapiens
agatggagattcagaaacata

SEQ ID NO: 46118 - DNA, 18 bp, Homo sapiens
cttgatgctgcttgggcc

SEQ ID NO: 46119 - DNA, 19 bp, Homo sapiens
ggacaacaagaaacttccc

SEQ ID NO: 46120 - DNA, 24 bp, Homo sapiens
tgcagggctgcgggcgcttggttc

SEQ ID NO: 46121 - DNA, 22 bp, Homo sapiens
gctgcattggaattgtgtgttg

SEQ ID NO: 46122 - DNA, 21 bp, Homo sapiens
tccagtgggtgactggcccag

SEQ ID NO: 46123 - DNA, 16 bp, Homo sapiens
tgttggtgtatctgaa

SEQ ID NO: 46124 - DNA, 18 bp, Homo sapiens
accaccacctgcttgctc

SEQ ID NO: 46125 - DNA, 21 bp, Homo sapiens
cttgttaaccaagttactttt

SEQ ID NO: 46126 - DNA, 23 bp, Homo sapiens
accatcgccaccccagtaatcac

SEQ ID NO: 46127 - DNA, 19 bp, Homo sapiens
ctcctggactcaagtgatc

SEQ ID NO: 46128 - DNA, 19 bp, Homo sapiens
gaaccaggagaattgcttg

SEQ ID NO: 46129 - DNA, 21 bp, Homo sapiens
tccaatttactcctcatgaca

SEQ ID NO: 46130 - DNA, 19 bp, Homo sapiens
ttctctactaaaaatacaa

SEQ ID NO: 46131 - DNA, 21 bp, Homo sapiens
atgcccaggtctgcctactcc

SEQ ID NO: 46132 - DNA, 16 bp, Homo sapiens
caattgcagaaacatt

SEQ ID NO: 46133 - DNA, 18 bp, Homo sapiens
cagtgctctctggtttgc

SEQ ID NO: 46134 - DNA, 16 bp, Homo sapiens
catctgtcatatgagg

SEQ ID NO: 46135 - DNA, 21 bp, Homo sapiens
ctggcactactcagcgtgcta

SEQ ID NO: 46136 - DNA, 20 bp, Homo sapiens
gctgaggtctcctctgcctc

SEQ ID NO: 46137 - DNA, 20 bp, Homo sapiens
tctccccccaggatcaggga

SEQ ID NO: 46138 - DNA, 20 bp, Homo sapiens
tgcccaggtctgcctactcc

SEQ ID NO: 46139 - DNA, 23 bp, Homo sapiens
ttctgtctcccatgtccctgcga

SEQ ID NO: 46140 - DNA, 19 bp, Homo sapiens
ccaaaccccaaggccctca

SEQ ID NO: 46141 - DNA, 17 bp, Homo sapiens
ggccctcatctgccttt

SEQ ID NO: 46142 - DNA, 18 bp, Homo sapiens
gcagagtatctgcaggtg

SEQ ID NO: 46143 - DNA, 23 bp, Homo sapiens
tcactttgaccatgctacgtcac

SEQ ID NO: 46144 - DNA, 17 bp, Homo sapiens
gcaacctcagccaatga

SEQ ID NO: 46145 - DNA, 23 bp, Homo sapiens
acggagtctgcccaggccacacc

SEQ ID NO: 46146 - DNA, 16 bp, Homo sapiens
accagagattgtaata

SEQ ID NO: 46147 - DNA, 19 bp, Homo sapiens
cttgccttctaggtcactt

SEQ ID NO: 46148 - DNA, 19 bp, Homo sapiens
gagataaagagcagctggg

SEQ ID NO: 46149 - DNA, 17 bp, Homo sapiens
tgtgaacaccaacttct

SEQ ID NO: 46150 - DNA, 23 bp, Homo sapiens
cagcataaagcaaatgtaaccct

SEQ ID NO: 46151 - DNA, 20 bp, Homo sapiens
ccatgctctacagcacttca

SEQ ID NO: 46152 - DNA, 23 bp, Homo sapiens
accccactcccggcctgacacca

SEQ ID NO: 46153 - DNA, 24 bp, Homo sapiens
caagcatcatggtttccccagtgg

SEQ ID NO: 46154 - DNA, 21 bp, Homo sapiens
cagagctaattaaacatttca

SEQ ID NO: 46155 - DNA, 19 bp, Homo sapiens
tatggtaacaacaataaat

SEQ ID NO: 46156 - DNA, 19 bp, Homo sapiens
tatttttttacttcttgca

SEQ ID NO: 46157 - DNA, 19 bp, Homo sapiens
ttcctgtgccagtgctgaa

SEQ ID NO: 46158 - DNA, 24 bp, Homo sapiens
ccccttggtcacatgaaccaggga

SEQ ID NO: 46159 - DNA, 19 bp, Homo sapiens
gacttctagtgtggaagtg

SEQ ID NO: 46160 - DNA, 17 bp, Homo sapiens
gagtgcaagcatggaac

SEQ ID NO: 46161 - DNA, 22 bp, Homo sapiens
cactgtaccacagcctgagcaa

SEQ ID NO: 46162 - DNA, 16 bp, Homo sapiens
tcccagcaggctgcaa

SEQ ID NO: 46163 - DNA, 19 bp, Homo sapiens
aggaaagagaaatgtcacc

SEQ ID NO: 46164 - DNA, 17 bp, Homo sapiens
cagctttcaaatcttcc

SEQ ID NO: 46165 - DNA, 22 bp, Homo sapiens
tcatgaaatgcaaaacaatagg

SEQ ID NO: 46166 - DNA, 21 bp, Homo sapiens
tccaatacaatgcctcttctc

SEQ ID NO: 46167 - DNA, 18 bp, Homo sapiens
tggaagagagggttctga

SEQ ID NO: 46168 - DNA, 20 bp, Homo sapiens
ttttaggaatgaaggtgtct

SEQ ID NO: 46169 - DNA, 23 bp, Homo sapiens
atagcataggcagcctgactcca

SEQ ID NO: 46170 - DNA, 16 bp, Homo sapiens
gccctattttacagct

SEQ ID NO: 46171 - DNA, 17 bp, Homo sapiens
tcaaacattaaaatgtg

SEQ ID NO: 46172 - DNA, 17 bp, Homo sapiens
tcatctgcaatatttgg

SEQ ID NO: 46173 - DNA, 24 bp, Homo sapiens
attctgatgattactcagaactct

SEQ ID NO: 46174 - DNA, 18 bp, Homo sapiens
gtgaagacaggtgctcgc

SEQ ID NO: 46175 - DNA, 19 bp, Homo sapiens
ctgcaagctccgcctccca

SEQ ID NO: 46176 - DNA, 18 bp, Homo sapiens
tccgcctcccaggttcaa

SEQ ID NO: 46177 - DNA, 20 bp, Homo sapiens
aagatgcactaagatgtggt

SEQ ID NO: 46178 - DNA, 18 bp, Homo sapiens
agtaccaatttcaatcca

SEQ ID NO: 46179 - DNA, 18 bp, Homo sapiens
ggcacaagctctggccca

SEQ ID NO: 46180 - DNA, 19 bp, Homo sapiens
tatccttctcgagttccca

SEQ ID NO: 46181 - DNA, 19 bp, Homo sapiens
ttctctactaaaaatgcaa

SEQ ID NO: 46182 - DNA, 19 bp, Homo sapiens
ttcttacccaacacatcaa

SEQ ID NO: 46183 - DNA, 22 bp, Homo sapiens
cagcatcaccaacggtgaagaa

SEQ ID NO: 46184 - DNA, 21 bp, Homo sapiens
gcccttcacaaactgcggcct

SEQ ID NO: 46185 - DNA, 18 bp, Homo sapiens
ggcttggcccagcctcca

SEQ ID NO: 46186 - DNA, 21 bp, Homo sapiens
tgcccagaacaggtggcccag

SEQ ID NO: 46187 - DNA, 21 bp, Homo sapiens
ttcacaaactgcggcctggca

SEQ ID NO: 46188 - DNA, 20 bp, Homo sapiens
ttttatacacagagccatta

SEQ ID NO: 46189 - DNA, 18 bp, Homo sapiens
atagaacctttgattttt

SEQ ID NO: 46190 - DNA, 16 bp, Homo sapiens
gcggccaacattccag

SEQ ID NO: 46191 - DNA, 19 bp, Homo sapiens
gtgcaggtatgactgtgtt

SEQ ID NO: 46192 - DNA, 20 bp, Homo sapiens
tggcattccagcaggagcta

SEQ ID NO: 46193 - DNA, 19 bp, Homo sapiens
cctatggcatgatgaactt

SEQ ID NO: 46194 - DNA, 20 bp, Homo sapiens
gctccagggactcttgggga

SEQ ID NO: 46195 - DNA, 23 bp, Homo sapiens
gaaagataagacgccccctttca

SEQ ID NO: 46196 - DNA, 17 bp, Homo sapiens
gaactcgccagcagcta

SEQ ID NO: 46197 - DNA, 19 bp, Homo sapiens
gaactcgccagcagctagc

SEQ ID NO: 46198 - DNA, 18 bp, Homo sapiens
gatcccttctgagctcac

SEQ ID NO: 46199 - DNA, 18 bp, Homo sapiens
ggcttggcacccgccaaa

SEQ ID NO: 46200 - DNA, 19 bp, Homo sapiens
agaaaattcagatcagcaa

SEQ ID NO: 46201 - DNA, 18 bp, Homo sapiens
cccgcatcctccacctcc

SEQ ID NO: 46202 - DNA, 22 bp, Homo sapiens
taaatgaatagtgatgtggagc

SEQ ID NO: 46203 - DNA, 18 bp, Homo sapiens
tccacctcccaggttcaa

SEQ ID NO: 46204 - DNA, 20 bp, Homo sapiens
ttgatacattattataaact

SEQ ID NO: 46205 - DNA, 16 bp, Homo sapiens
ttgggtgaaatgtctg

SEQ ID NO: 46206 - DNA, 19 bp, Homo sapiens
cgaatctgtgactgcctct

SEQ ID NO: 46207 - DNA, 19 bp, Homo sapiens
acttggattgcatttggct

SEQ ID NO: 46208 - DNA, 20 bp, Homo sapiens
cccagagcttggcgtttcag

SEQ ID NO: 46209 - DNA, 18 bp, Homo sapiens
ctgaaaaccctctgatgc

SEQ ID NO: 46210 - DNA, 23 bp, Homo sapiens
cttctcccgtcctcccctcccct

SEQ ID NO: 46211 - DNA, 19 bp, Homo sapiens
gccatgggaagggcccagg

SEQ ID NO: 46212 - DNA, 22 bp, Homo sapiens
ggaggaggagggggaccagcca

SEQ ID NO: 46213 - DNA, 19 bp, Homo sapiens
tcaatagggatgatgacgg

SEQ ID NO: 46214 - DNA, 21 bp, Homo sapiens
tcctcccctccccttcccttg

SEQ ID NO: 46215 - DNA, 18 bp, Homo sapiens
tcttttctgtgttttaac

SEQ ID NO: 46216 - DNA, 15 bp, Homo sapiens
tgttgagtacagacc

SEQ ID NO: 46217 - DNA, 18 bp, Homo sapiens
cccccgacgccctccccg

SEQ ID NO: 46218 - DNA, 19 bp, Homo sapiens
gccagcctctcgggagtca

SEQ ID NO: 46219 - DNA, 24 bp, Homo sapiens
tcagccctgcggtcctgccgcgca

SEQ ID NO: 46220 - DNA, 19 bp, Homo sapiens
cttgcccagaactacttct

SEQ ID NO: 46221 - DNA, 22 bp, Homo sapiens
gcctcctcactgtctacctcca

SEQ ID NO: 46222 - DNA, 23 bp, Homo sapiens
gcttggagttgctgtcctggccc

SEQ ID NO: 46223 - DNA, 18 bp, Homo sapiens
ggtgggaacccccttcca

SEQ ID NO: 46224 - DNA, 19 bp, Homo sapiens
agctgtgggtacccgggag

SEQ ID NO: 46225 - DNA, 16 bp, Homo sapiens
ccacagctgcgcctgg

SEQ ID NO: 46226 - DNA, 20 bp, Homo sapiens
gggccctcccctgctgccac

SEQ ID NO: 46227 - DNA, 22 bp, Homo sapiens
accccttctctcctacctctga

SEQ ID NO: 46228 - DNA, 21 bp, Homo sapiens
atcaatgtgattcattgatgt

SEQ ID NO: 46229 - DNA, 23 bp, Homo sapiens
atcatttatcatgttcacagatt

SEQ ID NO: 46230 - DNA, 22 bp, Homo sapiens
tcagggcgcacgtgtttgttca

SEQ ID NO: 46231 - DNA, 23 bp, Homo sapiens
ttgtaaggatcatgggaaatcta

SEQ ID NO: 46232 - DNA, 20 bp, Homo sapiens
tggccaggctggtcttgaac

SEQ ID NO: 46233 - DNA, 19 bp, Homo sapiens
aagcaattctcctgcctca

SEQ ID NO: 46234 - DNA, 22 bp, Homo sapiens
atgtactcacactgctcttcct

SEQ ID NO: 46235 - DNA, 17 bp, Homo sapiens
caccaggccccgttgca

SEQ ID NO: 46236 - DNA, 18 bp, Homo sapiens
cctgcaacctccacctcc

SEQ ID NO: 46237 - DNA, 19 bp, Homo sapiens
tagggttatgttttcagtt

SEQ ID NO: 46238 - DNA, 22 bp, Homo sapiens
tctgcctggcagcctagcctca

SEQ ID NO: 46239 - DNA, 22 bp, Homo sapiens
tcttggtggcatcaagcttgtg

SEQ ID NO: 46240 - DNA, 20 bp, Homo sapiens
tggccaggctggtcttgaac

SEQ ID NO: 46241 - DNA, 18 bp, Homo sapiens
caacaggagagccacttt

SEQ ID NO: 46242 - DNA, 18 bp, Homo sapiens
ccttggggttttgatcag

SEQ ID NO: 46243 - DNA, 19 bp, Homo sapiens
ctgagtctgggtctgggtc

SEQ ID NO: 46244 - DNA, 17 bp, Homo sapiens
ctgttttgctccatccc

SEQ ID NO: 46245 - DNA, 21 bp, Homo sapiens
gcttgggtctgagtctgggtc

SEQ ID NO: 46246 - DNA, 19 bp, Homo sapiens
ggacagggaaagggccacc

SEQ ID NO: 46247 - DNA, 24 bp, Homo sapiens
tgaatgtgagccgatatgcagctg

SEQ ID NO: 46248 - DNA, 17 bp, Homo sapiens
cccaggagcccgcccag

SEQ ID NO: 46249 - DNA, 18 bp, Homo sapiens
acaccgcactgccaatat

SEQ ID NO: 46250 - DNA, 22 bp, Homo sapiens
atgctcagaatctaatattcaa

SEQ ID NO: 46251 - DNA, 18 bp, Homo sapiens
caggtgcagcctccttca

SEQ ID NO: 46252 - DNA, 19 bp, Homo sapiens
gttatggaaatacagatta

SEQ ID NO: 46253 - DNA, 17 bp, Homo sapiens
tattaaatgtgttgtta

SEQ ID NO: 46254 - DNA, 19 bp, Homo sapiens
tcctttagatccaatcgga

SEQ ID NO: 46255 - DNA, 18 bp, Homo sapiens
gaatttttgaattctgga

SEQ ID NO: 46256 - DNA, 18 bp, Homo sapiens
tatcctaagcctcctgga

SEQ ID NO: 46257 - DNA, 18 bp, Homo sapiens
tgggtggatcacctgagg

SEQ ID NO: 46258 - DNA, 18 bp, Homo sapiens
ttgcaggaggccaagctc

SEQ ID NO: 46259 - DNA, 16 bp, Homo sapiens
ctccctccctgtctct

SEQ ID NO: 46260 - DNA, 22 bp, Homo sapiens
ctggctaagcggtcttaagcac

SEQ ID NO: 46261 - DNA, 18 bp, Homo sapiens
ggccaagacaacaacatc

SEQ ID NO: 46262 - DNA, 18 bp, Homo sapiens
aaggtgttacaaagagca

SEQ ID NO: 46263 - DNA, 22 bp, Homo sapiens
catttccggtgggctctgggga

SEQ ID NO: 46264 - DNA, 20 bp, Homo sapiens
gctcacactctcctctcaca

SEQ ID NO: 46265 - DNA, 19 bp, Homo sapiens
ggcttctgcagtcatgttt

SEQ ID NO: 46266 - DNA, 17 bp, Homo sapiens
tcaccaatatcattgga

SEQ ID NO: 46267 - DNA, 21 bp, Homo sapiens
tctcaccatatgtaccaaaga

SEQ ID NO: 46268 - DNA, 17 bp, Homo sapiens
tgctcccagagacactg

SEQ ID NO: 46269 - DNA, 21 bp, Homo sapiens
ttgcagatgctaccctcatac

SEQ ID NO: 46270 - DNA, 18 bp, Homo sapiens
gtgtcaggctcattccca

SEQ ID NO: 46271 - DNA, 21 bp, Homo sapiens
aggcacctgtgcccaccccct

SEQ ID NO: 46272 - DNA, 17 bp, Homo sapiens
ccatttccacccccaaa

SEQ ID NO: 46273 - DNA, 18 bp, Homo sapiens
cccccaaatacctcccca

SEQ ID NO: 46274 - DNA, 24 bp, Homo sapiens
ctccaactgtgccccatttccacc

SEQ ID NO: 46275 - DNA, 23 bp, Homo sapiens
atcagccaagcaggctgctgaga

SEQ ID NO: 46276 - DNA, 18 bp, Homo sapiens
atggagtctccctctgtc

SEQ ID NO: 46277 - DNA, 26 bp, Homo sapiens
tcatcctcctaaatttcactgtctta

SEQ ID NO: 46278 - DNA, 18 bp, Homo sapiens
tctgcccacctctgcctc

SEQ ID NO: 46279 - DNA, 21 bp, Homo sapiens
caggacaccagctgggtccag

SEQ ID NO: 46280 - DNA, 17 bp, Homo sapiens
ccgcccaccgccactat

SEQ ID NO: 46281 - DNA, 19 bp, Homo sapiens
ctgctcccacacctgcgcc

SEQ ID NO: 46282 - DNA, 19 bp, Homo sapiens
ggcttctgtggacgactca

SEQ ID NO: 46283 - DNA, 22 bp, Homo sapiens
tgcctcccctctgcccatctct

SEQ ID NO: 46284 - DNA, 17 bp, Homo sapiens
tgctcccacacctgcgc

SEQ ID NO: 46285 - DNA, 19 bp, Homo sapiens
aacccagccctgcacacca

SEQ ID NO: 46286 - DNA, 18 bp, Homo sapiens
acaacaagctcctcacca

SEQ ID NO: 46287 - DNA, 21 bp, Homo sapiens
agctgggttactttgacctca

SEQ ID NO: 46288 - DNA, 21 bp, Homo sapiens
cctcggcggccacttgaccaa

SEQ ID NO: 46289 - DNA, 22 bp, Homo sapiens
acttgagatttcctgaagcgca

SEQ ID NO: 46290 - DNA, 20 bp, Homo sapiens
atctgcatctcagcctgaga

SEQ ID NO: 46291 - DNA, 17 bp, Homo sapiens
caaaaacgctgacatgc

SEQ ID NO: 46292 - DNA, 18 bp, Homo sapiens
gtggggggccgagtgctg

SEQ ID NO: 46293 - DNA, 19 bp, Homo sapiens
tcaaaaacgctgacatgca

SEQ ID NO: 46294 - DNA, 23 bp, Homo sapiens
gtctctgaggcctcatccagttc

SEQ ID NO: 46295 - DNA, 21 bp, Homo sapiens
atgtattttgtgagtttctcc

SEQ ID NO: 46296 - DNA, 18 bp, Homo sapiens
catccattcctgagctca

SEQ ID NO: 46297 - DNA, 19 bp, Homo sapiens
gagatttcaaggctcagca

SEQ ID NO: 46298 - DNA, 25 bp, Homo sapiens
tgaatgtggctacctaatgtggaac

SEQ ID NO: 46299 - DNA, 19 bp, Homo sapiens
ccaagtcccactctctgga

SEQ ID NO: 46300 - DNA, 26 bp, Homo sapiens
acccaggagggatgacggagctgcca

SEQ ID NO: 46301 - DNA, 16 bp, Homo sapiens
agcaaacaaaatcatg

SEQ ID NO: 46302 - DNA, 23 bp, Homo sapiens
ggcagcaaacaaaatcatgcaca

SEQ ID NO: 46303 - DNA, 22 bp, Homo sapiens
tcccaggttccaagctctgggc

SEQ ID NO: 46304 - DNA, 23 bp, Homo sapiens
cactccagtgttcccagccccaa

SEQ ID NO: 46305 - DNA, 22 bp, Homo sapiens
ctccttctctctgtctacctca

SEQ ID NO: 46306 - DNA, 22 bp, Homo sapiens
ccaccagtcccagaacccgcca

SEQ ID NO: 46307 - DNA, 25 bp, Homo sapiens
ccctggggatggggtggtctgtgaa

SEQ ID NO: 46308 - DNA, 20 bp, Homo sapiens
tcaacagcacactcagtgca

SEQ ID NO: 46309 - DNA, 27 bp, Homo sapiens
gacccctaagagttcaagccatgctgg

SEQ ID NO: 46310 - DNA, 19 bp, Homo sapiens
caccactcacccattcttt

SEQ ID NO: 46311 - DNA, 18 bp, Homo sapiens
ctcttgtcctcctgcctc

SEQ ID NO: 46312 - DNA, 23 bp, Homo sapiens
atctaccaaaacaagatctgcca

SEQ ID NO: 46313 - DNA, 18 bp, Homo sapiens
ggctaatagcacttctcc

SEQ ID NO: 46314 - DNA, 19 bp, Homo sapiens
ccttcagagaagcagacca

SEQ ID NO: 46315 - DNA, 26 bp, Homo sapiens
cctccccagcctccagctcctctcca

SEQ ID NO: 46316 - DNA, 17 bp, Homo sapiens
tttcatgtgaaatcatc

SEQ ID NO: 46317 - DNA, 18 bp, Homo sapiens
agctacctcccttctgtg

SEQ ID NO: 46318 - DNA, 22 bp, Homo sapiens
cagaaaaactgctgaattctgg

SEQ ID NO: 46319 - DNA, 19 bp, Homo sapiens
cgccgagtccgcgagctct

SEQ ID NO: 46320 - DNA, 18 bp, Homo sapiens
gatcctagcgcggagctg

SEQ ID NO: 46321 - DNA, 24 bp, Homo sapiens
gcgaggagaggcagcactgctgct

SEQ ID NO: 46322 - DNA, 19 bp, Homo sapiens
gatggacttaactgtgaaa

SEQ ID NO: 46323 - DNA, 19 bp, Homo sapiens
atagacatacagagatata

SEQ ID NO: 46324 - DNA, 18 bp, Homo sapiens
cctgaaccagcctggtcc

SEQ ID NO: 46325 - DNA, 21 bp, Homo sapiens
gacaatctatttcttgagcca

SEQ ID NO: 46326 - DNA, 20 bp, Homo sapiens
aactagctaactttgtactt

SEQ ID NO: 46327 - DNA, 19 bp, Homo sapiens
aacttctgtttaaagatgc

SEQ ID NO: 46328 - DNA, 18 bp, Homo sapiens
aatgcagtaggcaaatgt

SEQ ID NO: 46329 - DNA, 21 bp, Homo sapiens
agaggagatgaatcatgttgc

SEQ ID NO: 46330 - DNA, 21 bp, Homo sapiens
atatggctcaaggactgccgg

SEQ ID NO: 46331 - DNA, 26 bp, Homo sapiens
gaatcacactatagtttaatgacata

SEQ ID NO: 46332 - DNA, 19 bp, Homo sapiens
taaatgggctttaattttg

SEQ ID NO: 46333 - DNA, 25 bp, Homo sapiens
ttgttcaaatattagagttagggta

SEQ ID NO: 46334 - DNA, 17 bp, Homo sapiens
atgttgacatcgacttt

SEQ ID NO: 46335 - DNA, 20 bp, Homo sapiens
ctctgaaccagaagtcatca

SEQ ID NO: 46336 - DNA, 17 bp, Homo sapiens
gcccagtggctttaaac

SEQ ID NO: 46337 - DNA, 18 bp, Homo sapiens
ggacctaaaacagtgtct

SEQ ID NO: 46338 - DNA, 19 bp, Homo sapiens
tgcaaggtgctgcctaact

SEQ ID NO: 46339 - DNA, 18 bp, Homo sapiens
gcctgagtcccaggagtc

SEQ ID NO: 46340 - DNA, 20 bp, Homo sapiens
tgactgcacaaatcagctca

SEQ ID NO: 46341 - DNA, 18 bp, Homo sapiens
acacaggaggcggtgctg

SEQ ID NO: 46342 - DNA, 18 bp, Homo sapiens
cccccgtcaccccctccc

SEQ ID NO: 46343 - DNA, 24 bp, Homo sapiens
cgagcggaagcttcccgcccggcc

SEQ ID NO: 46344 - DNA, 20 bp, Homo sapiens
cgcgggctccccgtgcccgt

SEQ ID NO: 46345 - DNA, 26 bp, Homo sapiens
ctccccctctagaataccaggatcct

SEQ ID NO: 46346 - DNA, 19 bp, Homo sapiens
ctctagaataccaggatcc

SEQ ID NO: 46347 - DNA, 23 bp, Homo sapiens
gccgcgggctcaggctgaggcct

SEQ ID NO: 46348 - DNA, 23 bp, Homo sapiens
gctcccctgtcccctgctcttct

SEQ ID NO: 46349 - DNA, 22 bp, Homo sapiens
gctctgagaattagcttcactt

SEQ ID NO: 46350 - DNA, 22 bp, Homo sapiens
tctctgccgtggaagggactca

SEQ ID NO: 46351 - DNA, 19 bp, Homo sapiens
tggccgctgggctgtgaac

SEQ ID NO: 46352 - DNA, 22 bp, Homo sapiens
tgttaatccattttttacattt

SEQ ID NO: 46353 - DNA, 20 bp, Homo sapiens
cccagcccactcctgttcca

SEQ ID NO: 46354 - DNA, 18 bp, Homo sapiens
gcgctaggaggggtccgg

SEQ ID NO: 46355 - DNA, 22 bp, Homo sapiens
ggccaatcaggcgcgagcacct

SEQ ID NO: 46356 - DNA, 23 bp, Homo sapiens
attgaagtaggctcaaaccctca

SEQ ID NO: 46357 - DNA, 24 bp, Homo sapiens
acaatttttaaataaaggatacca

SEQ ID NO: 46358 - DNA, 21 bp, Homo sapiens
gcagcttcagacatttggtta

SEQ ID NO: 46359 - DNA, 27 bp, Homo sapiens
aggaaagaaaaaaaggaaaggaacctt

SEQ ID NO: 46360 - DNA, 24 bp, Homo sapiens
ctctttgggttagtgtggtatgta

SEQ ID NO: 46361 - DNA, 18 bp, Homo sapiens
gtggattggtgccagaga

SEQ ID NO: 46362 - DNA, 17 bp, Homo sapiens
gaataaaaagaagattc

SEQ ID NO: 46363 - DNA, 17 bp, Homo sapiens
gactcaacaaacatcca

SEQ ID NO: 46364 - DNA, 17 bp, Homo sapiens
tcttgttccttaacttt

SEQ ID NO: 46365 - DNA, 18 bp, Homo sapiens
atcgtccatcctacaggt

SEQ ID NO: 46366 - DNA, 20 bp, Homo sapiens
tctacaaggtgttgtggcca

SEQ ID NO: 46367 - DNA, 22 bp, Homo sapiens
caggatgtgaaaagattgcctc

SEQ ID NO: 46368 - DNA, 21 bp, Homo sapiens
cctaggggcctgatcattttt

SEQ ID NO: 46369 - DNA, 17 bp, Homo sapiens
tgctataggatgctata

SEQ ID NO: 46370 - DNA, 23 bp, Homo sapiens
tgggatgacggaagacctgggga

SEQ ID NO: 46371 - DNA, 17 bp, Homo sapiens
acaacatactaggcact

SEQ ID NO: 46372 - DNA, 22 bp, Homo sapiens
accagaaggaagaaactctgaa

SEQ ID NO: 46373 - DNA, 22 bp, Homo sapiens
actcaccgcgagggtccgcggc

SEQ ID NO: 46374 - DNA, 17 bp, Homo sapiens
gccacacctcagcctcc

SEQ ID NO: 46375 - DNA, 22 bp, Homo sapiens
ggcttagcaacactgctcacca

SEQ ID NO: 46376 - DNA, 19 bp, Homo sapiens
aaacacatatcaagatcca

SEQ ID NO: 46377 - DNA, 17 bp, Homo sapiens
gcaacctcagccaatga

SEQ ID NO: 46378 - DNA, 19 bp, Homo sapiens
actggtggcaggctgtggc

SEQ ID NO: 46379 - DNA, 16 bp, Homo sapiens
ccactccacattctct

SEQ ID NO: 46380 - DNA, 20 bp, Homo sapiens
gcccgaggcaatgaacagta

SEQ ID NO: 46381 - DNA, 21 bp, Homo sapiens
ggcctcaatgttctcatttta

SEQ ID NO: 46382 - DNA, 16 bp, Homo sapiens
tcgatgtccctgactt

SEQ ID NO: 46383 - DNA, 23 bp, Homo sapiens
tctgttctaaacagattgtgcaa

SEQ ID NO: 46384 - DNA, 17 bp, Homo sapiens
aggagcgcagttaccag

SEQ ID NO: 46385 - DNA, 20 bp, Homo sapiens
actcaaggaggctgggtttc

SEQ ID NO: 46386 - DNA, 20 bp, Homo sapiens
ttttattttgccatcagtta

SEQ ID NO: 46387 - DNA, 21 bp, Homo sapiens
agctgaacgcctgcttagctt

SEQ ID NO: 46388 - DNA, 22 bp, Homo sapiens
cctgccttctcgtattgctgct

SEQ ID NO: 46389 - DNA, 20 bp, Homo sapiens
tagatggaccccaaaactga

SEQ ID NO: 46390 - DNA, 20 bp, Homo sapiens
tcctgaacctcaaatcaaca

SEQ ID NO: 46391 - DNA, 21 bp, Homo sapiens
tgtctctcctgccttctgctt

SEQ ID NO: 46392 - DNA, 18 bp, Homo sapiens
acccaaaaaggtaagttt

SEQ ID NO: 46393 - DNA, 17 bp, Homo sapiens
gaatctgcatctgagaa

SEQ ID NO: 46394 - DNA, 19 bp, Homo sapiens
tacttagtaactcactttt

SEQ ID NO: 46395 - DNA, 17 bp, Homo sapiens
aatgcttagttaacaag

SEQ ID NO: 46396 - DNA, 18 bp, Homo sapiens
acaactccactctgtgac

SEQ ID NO: 46397 - DNA, 24 bp, Homo sapiens
agaatagctacaaacaactggtca

SEQ ID NO: 46398 - DNA, 24 bp, Homo sapiens
agagagtacctgacttcagaccac

SEQ ID NO: 46399 - DNA, 20 bp, Homo sapiens
cacggggagtcccattgcca

SEQ ID NO: 46400 - DNA, 23 bp, Homo sapiens
ccactgctggggaaaatgtgcca

SEQ ID NO: 46401 - DNA, 22 bp, Homo sapiens
gaagttaaactttacaaaatga

SEQ ID NO: 46402 - DNA, 22 bp, Homo sapiens
gaatagctacaaacaactggtc

SEQ ID NO: 46403 - DNA, 18 bp, Homo sapiens
gggcctccacatcctcca

SEQ ID NO: 46404 - DNA, 20 bp, Homo sapiens
tgcccaagattattctctca

SEQ ID NO: 46405 - DNA, 21 bp, Homo sapiens
tggattcgtaaggtgaggctg

SEQ ID NO: 46406 - DNA, 18 bp, Homo sapiens
agaaaaactttggacaaa

SEQ ID NO: 46407 - DNA, 18 bp, Homo sapiens
ccttgatcttggacttgc

SEQ ID NO: 46408 - DNA, 19 bp, Homo sapiens
tataaaaagagacacaaga

SEQ ID NO: 46409 - DNA, 22 bp, Homo sapiens
tctttttcaacagaacttcaca

SEQ ID NO: 46410 - DNA, 16 bp, Homo sapiens
gacccacgtggaactg

SEQ ID NO: 46411 - DNA, 18 bp, Homo sapiens
agaaaccctcatctctac

SEQ ID NO: 46412 - DNA, 20 bp, Homo sapiens
cgaagaaaccctcatctcta

SEQ ID NO: 46413 - DNA, 22 bp, Homo sapiens
gagccaagattgtgccactgca

SEQ ID NO: 46414 - DNA, 20 bp, Homo sapiens
tacaacctgggcaacagagc

SEQ ID NO: 46415 - DNA, 21 bp, Homo sapiens
tcccactactgatcagtactg

SEQ ID NO: 46416 - DNA, 19 bp, Homo sapiens
tttaggagacgtggtaggt

SEQ ID NO: 46417 - DNA, 16 bp, Homo sapiens
tgcgtacatatgtggt

SEQ ID NO: 46418 - DNA, 19 bp, Homo sapiens
cacagctggctcgtggctg

SEQ ID NO: 46419 - DNA, 28 bp, Homo sapiens
ccaaaacaatattacaagtttaatatca

SEQ ID NO: 46420 - DNA, 20 bp, Homo sapiens
taatgctttctaacatgaag

SEQ ID NO: 46421 - DNA, 18 bp, Homo sapiens
atgaatgttaaaaatgaa

SEQ ID NO: 46422 - DNA, 18 bp, Homo sapiens
ttctctatcactcacaac

SEQ ID NO: 46423 - DNA, 25 bp, Homo sapiens
ttgcaacctccgcttcctggattca

SEQ ID NO: 46424 - DNA, 18 bp, Homo sapiens
gcccacggcctccagtca

SEQ ID NO: 46425 - DNA, 18 bp, Homo sapiens
acccaccttctcacttcc

SEQ ID NO: 46426 - DNA, 17 bp, Homo sapiens
gaccctggctgactgca

SEQ ID NO: 46427 - DNA, 17 bp, Homo sapiens
gcgtatgtgccctgggt

SEQ ID NO: 46428 - DNA, 21 bp, Homo sapiens
ggttgcccctctactcagaga

SEQ ID NO: 46429 - DNA, 17 bp, Homo sapiens
cctggtctctggctgtc

SEQ ID NO: 46430 - DNA, 18 bp, Homo sapiens
cgatcttccggaagacac

SEQ ID NO: 46431 - DNA, 20 bp, Homo sapiens
gcaaactgtgaagtgcagtg

SEQ ID NO: 46432 - DNA, 20 bp, Homo sapiens
ggaagagcttgggcgacatg

SEQ ID NO: 46433 - DNA, 22 bp, Homo sapiens
caagacaacaacagtggtgggc

SEQ ID NO: 46434 - DNA, 24 bp, Homo sapiens
gccaaagtccccagtggcaaatca

SEQ ID NO: 46435 - DNA, 21 bp, Homo sapiens
tcagttcaaaacaacacatga

SEQ ID NO: 46436 - DNA, 21 bp, Homo sapiens
ggaggaggcagtatggcaaga

SEQ ID NO: 46437 - DNA, 20 bp, Homo sapiens
acaacaggtacaaagtccta

SEQ ID NO: 46438 - DNA, 18 bp, Homo sapiens
acagagggctccagacca

SEQ ID NO: 46439 - DNA, 18 bp, Homo sapiens
ccaaaaaacaaaaaaccc

SEQ ID NO: 46440 - DNA, 21 bp, Homo sapiens
aacactagaaaaaagaaatgt

SEQ ID NO: 46441 - DNA, 22 bp, Homo sapiens
gaaatttgagctaaacattttt

SEQ ID NO: 46442 - DNA, 20 bp, Homo sapiens
gcatttttctattttcccca

SEQ ID NO: 46443 - DNA, 20 bp, Homo sapiens
tagatggatactgaatactc

SEQ ID NO: 46444 - DNA, 21 bp, Homo sapiens
tggaaaaactagtgttaggga

SEQ ID NO: 46445 - DNA, 25 bp, Homo sapiens
agggaagtgatgttgggtcactttt

SEQ ID NO: 46446 - DNA, 19 bp, Homo sapiens
atacaacttaccctcatca

SEQ ID NO: 46447 - DNA, 20 bp, Homo sapiens
atcatggaggcaggtatttc

SEQ ID NO: 46448 - DNA, 21 bp, Homo sapiens
cagcaatgtagaactgtaagt

SEQ ID NO: 46449 - DNA, 22 bp, Homo sapiens
catgtgttgtgggagggaccca

SEQ ID NO: 46450 - DNA, 21 bp, Homo sapiens
cctttttacagtttttgactt

SEQ ID NO: 46451 - DNA, 23 bp, Homo sapiens
ctgcagaagctctatctttgatt

SEQ ID NO: 46452 - DNA, 19 bp, Homo sapiens
ctgcttttgctgtatccca

SEQ ID NO: 46453 - DNA, 18 bp, Homo sapiens
gcaatgattttgaagcct

SEQ ID NO: 46454 - DNA, 21 bp, Homo sapiens
ggcgtttcctcaggcctctca

SEQ ID NO: 46455 - DNA, 24 bp, Homo sapiens
ggtctgatggttttgaaaagggta

SEQ ID NO: 46456 - DNA, 24 bp, Homo sapiens
gtgtctgaactaccagtgagtttt

SEQ ID NO: 46457 - DNA, 20 bp, Homo sapiens
gttctttcacttcccaatgt

SEQ ID NO: 46458 - DNA, 19 bp, Homo sapiens
tcactgacagcttgcactg

SEQ ID NO: 46459 - DNA, 19 bp, Homo sapiens
ttgtcttttgacaatttta

SEQ ID NO: 46460 - DNA, 23 bp, Homo sapiens
tttagctactcctgattattttt

SEQ ID NO: 46461 - DNA, 22 bp, Homo sapiens
aaaatcaggaactatcattgga

SEQ ID NO: 46462 - DNA, 19 bp, Homo sapiens
acaaaatgacattccctca

SEQ ID NO: 46463 - DNA, 18 bp, Homo sapiens
agagattgagacaaaatg

SEQ ID NO: 46464 - DNA, 21 bp, Homo sapiens
cactccccgcagtccccctga

SEQ ID NO: 46465 - DNA, 19 bp, Homo sapiens
ctctcctttggctaatctg

SEQ ID NO: 46466 - DNA, 17 bp, Homo sapiens
ggaactatcattggaga

SEQ ID NO: 46467 - DNA, 22 bp, Homo sapiens
aaaatcaggaactatcattgga

SEQ ID NO: 46468 - DNA, 19 bp, Homo sapiens
acaaaatgacattccctca

SEQ ID NO: 46469 - DNA, 18 bp, Homo sapiens
agagattgagacaaaatg

SEQ ID NO: 46470 - DNA, 21 bp, Homo sapiens
cactccccgcagtccccctga

SEQ ID NO: 46471 - DNA, 19 bp, Homo sapiens
ctctcctttggctaatctg

SEQ ID NO: 46472 - DNA, 17 bp, Homo sapiens
ggaactatcattggaga

SEQ ID NO: 46473 - DNA, 19 bp, Homo sapiens
aaacacatatcaagatcca

SEQ ID NO: 46474 - DNA, 19 bp, Homo sapiens
ccccagcaacctcagccaa

SEQ ID NO: 46475 - DNA, 17 bp, Homo sapiens
gcaacctcagccaatga

SEQ ID NO: 46476 - DNA, 17 bp, Homo sapiens
ccgcagacgccttgtct

SEQ ID NO: 46477 - DNA, 24 bp, Homo sapiens
tgggtggactccagcctccccagc

SEQ ID NO: 46478 - DNA, 19 bp, Homo sapiens
ttcccattcttgtacaata

SEQ ID NO: 46479 - DNA, 19 bp, Homo sapiens
aagagcaggaggccaggca

SEQ ID NO: 46480 - DNA, 19 bp, Homo sapiens
agacgatgaccacagcata

SEQ ID NO: 46481 - DNA, 20 bp, Homo sapiens
ggccacgttccaacaagtga

SEQ ID NO: 46482 - DNA, 21 bp, Homo sapiens
gtgggccccagtgagagactg

SEQ ID NO: 46483 - DNA, 21 bp, Homo sapiens
aagtcaggaccaggggtcgcc

SEQ ID NO: 46484 - DNA, 18 bp, Homo sapiens
tgactttgaactatgaag

SEQ ID NO: 46485 - DNA, 21 bp, Homo sapiens
tgggtgggcttagggacgctg

SEQ ID NO: 46486 - DNA, 24 bp, Homo sapiens
atcctcagcgcctgccaggagcca

SEQ ID NO: 46487 - DNA, 17 bp, Homo sapiens
cactgctaattcgggcc

SEQ ID NO: 46488 - DNA, 22 bp, Homo sapiens
tctgcctctcccacattcctcc

SEQ ID NO: 46489 - DNA, 20 bp, Homo sapiens
tgcctctcccacattcctcc

SEQ ID NO: 46490 - DNA, 19 bp, Homo sapiens
aactgccagactcaaaata

SEQ ID NO: 46491 - DNA, 16 bp, Homo sapiens
aatttttggtgcttgg

SEQ ID NO: 46492 - DNA, 20 bp, Homo sapiens
ccaagcaaagaattgtaact

SEQ ID NO: 46493 - DNA, 20 bp, Homo sapiens
cctttcctttgtcttgatct

SEQ ID NO: 46494 - DNA, 20 bp, Homo sapiens
ctaaatattgaaatcaatta

SEQ ID NO: 46495 - DNA, 22 bp, Homo sapiens
ctatttgagactaaagtagtat

SEQ ID NO: 46496 - DNA, 20 bp, Homo sapiens
gtagtttccttagtttttgt

SEQ ID NO: 46497 - DNA, 18 bp, Homo sapiens
tacagtatttgtgttggc

SEQ ID NO: 46498 - DNA, 17 bp, Homo sapiens
tcaagtgattctcctgc

SEQ ID NO: 46499 - DNA, 25 bp, Homo sapiens
tctttgtggtagtttccttagtttt

SEQ ID NO: 46500 - DNA, 22 bp, Homo sapiens
tctttttaataagaaactttgc

SEQ ID NO: 46501 - DNA, 20 bp, Homo sapiens
gatgtgagagtgtcattcca

SEQ ID NO: 46502 - DNA, 19 bp, Homo sapiens
ccctggcctctcagcagga

SEQ ID NO: 46503 - DNA, 20 bp, Homo sapiens
ctagcccagttcccatctag

SEQ ID NO: 46504 - DNA, 19 bp, Homo sapiens
ctgtctagcccagttccca

SEQ ID NO: 46505 - DNA, 22 bp, Homo sapiens
tcttgtaataggtgataatgtt

SEQ ID NO: 46506 - DNA, 24 bp, Homo sapiens
aggataatttgcatatccatcacc

SEQ ID NO: 46507 - DNA, 18 bp, Homo sapiens
agtattgcataactttaa

SEQ ID NO: 46508 - DNA, 19 bp, Homo sapiens
atcctggtggtaggtctct

SEQ ID NO: 46509 - DNA, 20 bp, Homo sapiens
caaaggatataaatgactaa

SEQ ID NO: 46510 - DNA, 18 bp, Homo sapiens
cctgagcctgcatggcct

SEQ ID NO: 46511 - DNA, 22 bp, Homo sapiens
gacaagcctgagcaacatatca

SEQ ID NO: 46512 - DNA, 19 bp, Homo sapiens
gacgcaggcgccattgcac

SEQ ID NO: 46513 - DNA, 18 bp, Homo sapiens
gagcagctacgtaacctg

SEQ ID NO: 46514 - DNA, 18 bp, Homo sapiens
gccatatcactgagggta

SEQ ID NO: 46515 - DNA, 17 bp, Homo sapiens
ggatcaggcagctccaa

SEQ ID NO: 46516 - DNA, 18 bp, Homo sapiens
ttacaccttctttctgta

SEQ ID NO: 46517 - DNA, 20 bp, Homo sapiens
ttatacatatttgtagggta

SEQ ID NO: 46518 - DNA, 18 bp, Homo sapiens
ccagcttctgggcccact

SEQ ID NO: 46519 - DNA, 23 bp, Homo sapiens
ggaccctccctgcccaccccctc

SEQ ID NO: 46520 - DNA, 17 bp, Homo sapiens
atgtgaacgggttattc

SEQ ID NO: 46521 - DNA, 19 bp, Homo sapiens
caaatattcaacaactcca

SEQ ID NO: 46522 - DNA, 18 bp, Homo sapiens
ccatgggatatggagcca

SEQ ID NO: 46523 - DNA, 15 bp, Homo sapiens
gtcaaggatctatag

SEQ ID NO: 46524 - DNA, 18 bp, Homo sapiens
gtcatatcaaaaatatca

SEQ ID NO: 46525 - DNA, 23 bp, Homo sapiens
ccaggcactaggcaaccaggggt

SEQ ID NO: 46526 - DNA, 19 bp, Homo sapiens
gttctacttctcaggctgg

SEQ ID NO: 46527 - DNA, 20 bp, Homo sapiens
ttttatgatgctttgacctt

SEQ ID NO: 46528 - DNA, 23 bp, Homo sapiens
accaccgggtcacactgctgcct

SEQ ID NO: 46529 - DNA, 16 bp, Homo sapiens
gtgtgagccagactga

SEQ ID NO: 46530 - DNA, 18 bp, Homo sapiens
tgaaccttcctgtgccac

SEQ ID NO: 46531 - DNA, 20 bp, Homo sapiens
tggggttgtggtgggcatcc

SEQ ID NO: 46532 - DNA, 18 bp, Homo sapiens
ttccagtgcctgatccag

SEQ ID NO: 46533 - DNA, 19 bp, Homo sapiens
aaaatcaccaggctcactc

SEQ ID NO: 46534 - DNA, 23 bp, Homo sapiens
gcttgcggcccgctggctcctca

SEQ ID NO: 46535 - DNA, 21 bp, Homo sapiens
cctccccgcaccgagttctca

SEQ ID NO: 46536 - DNA, 18 bp, Homo sapiens
ctctccttccaacctggt

SEQ ID NO: 46537 - DNA, 18 bp, Homo sapiens
gcctgctccacccaggga

SEQ ID NO: 46538 - DNA, 20 bp, Homo sapiens
gtcataatagacttccctct

SEQ ID NO: 46539 - DNA, 19 bp, Homo sapiens
tcctgtggaggctgccagc

SEQ ID NO: 46540 - DNA, 23 bp, Homo sapiens
cggatctctccaacagctgctcc

SEQ ID NO: 46541 - DNA, 20 bp, Homo sapiens
gcctgctccagctgcaggga

SEQ ID NO: 46542 - DNA, 23 bp, Homo sapiens
cggatctctccaacagctgctcc

SEQ ID NO: 46543 - DNA, 20 bp, Homo sapiens
gcctgctccagctgcaggga

SEQ ID NO: 46544 - DNA, 22 bp, Homo sapiens
tctggctgccaaagccatgaga

SEQ ID NO: 46545 - DNA, 20 bp, Homo sapiens
ttccagaatctgatcgccag

SEQ ID NO: 46546 - DNA, 24 bp, Homo sapiens
cttcacgccatattcttaccagtc

SEQ ID NO: 46547 - DNA, 19 bp, Homo sapiens
ccagccccaccgcccacct

SEQ ID NO: 46548 - DNA, 22 bp, Homo sapiens
gccaaagccaaacagaacttca

SEQ ID NO: 46549 - DNA, 20 bp, Homo sapiens
ctgtctccatctccacctcc

SEQ ID NO: 46550 - DNA, 20 bp, Homo sapiens
acccctaactttctcacctc

SEQ ID NO: 46551 - DNA, 22 bp, Homo sapiens
acacagagggacaaactcaaac

SEQ ID NO: 46552 - DNA, 20 bp, Homo sapiens
tcatcagagcctggaattca

SEQ ID NO: 46553 - DNA, 23 bp, Homo sapiens
tagccagaagcaaagccactgta

SEQ ID NO: 46554 - DNA, 22 bp, Homo sapiens
tccatgcaacttccctgttcct

SEQ ID NO: 46555 - DNA, 19 bp, Homo sapiens
caccaagagccctctgtca

SEQ ID NO: 46556 - DNA, 24 bp, Homo sapiens
cctctgtcatagcctatgctgcct

SEQ ID NO: 46557 - DNA, 18 bp, Homo sapiens
tggagcttgggatcctga

SEQ ID NO: 46558 - DNA, 20 bp, Homo sapiens
acagctcatgactcacctcc

SEQ ID NO: 46559 - DNA, 21 bp, Homo sapiens
ctaaaggaagccctctggagc

SEQ ID NO: 46560 - DNA, 16 bp, Homo sapiens
gaggactcataattga

SEQ ID NO: 46561 - DNA, 22 bp, Homo sapiens
ccagggtgcgctcagttgctgc

SEQ ID NO: 46562 - DNA, 21 bp, Homo sapiens
cactctccctatcccattaga

SEQ ID NO: 46563 - DNA, 20 bp, Homo sapiens
aaggaactgtccgcagtgtg

SEQ ID NO: 46564 - DNA, 18 bp, Homo sapiens
ccagcatccctgttccag

SEQ ID NO: 46565 - DNA, 17 bp, Homo sapiens
accacgggctgctggcc

SEQ ID NO: 46566 - DNA, 20 bp, Homo sapiens
gctggctcctgggcgcccca

SEQ ID NO: 46567 - DNA, 21 bp, Homo sapiens
catgctgggacatgccccccg

SEQ ID NO: 46568 - DNA, 19 bp, Homo sapiens
tccacttcacagatgagga

SEQ ID NO: 46569 - DNA, 20 bp, Homo sapiens
accgcccccgacgcccatgc

SEQ ID NO: 46570 - DNA, 19 bp, Homo sapiens
cctgggtaactgctggttc

SEQ ID NO: 46571 - DNA, 22 bp, Homo sapiens
agggcatcccccagactcaact

SEQ ID NO: 46572 - DNA, 20 bp, Homo sapiens
cccacgagccccaagcccct

SEQ ID NO: 46573 - DNA, 21 bp, Homo sapiens
cccagaaagcagaacccagga

SEQ ID NO: 46574 - DNA, 21 bp, Homo sapiens
ccttgatgagactgactgtgg

SEQ ID NO: 46575 - DNA, 23 bp, Homo sapiens
gcttgggcacagtgccctggctc

SEQ ID NO: 46576 - DNA, 20 bp, Homo sapiens
gggcacccccacttgcctcc

SEQ ID NO: 46577 - DNA, 19 bp, Homo sapiens
tcgatttgtcccctagctt

SEQ ID NO: 46578 - DNA, 18 bp, Homo sapiens
ttccagaaacactgcccc

SEQ ID NO: 46579 - DNA, 19 bp, Homo sapiens
ggggcggcctcgccgcgca

SEQ ID NO: 46580 - DNA, 16 bp, Homo sapiens
cgcccaacggcttttc

SEQ ID NO: 46581 - DNA, 21 bp, Homo sapiens
ctcaaccaccatggcccctga

SEQ ID NO: 46582 - DNA, 18 bp, Homo sapiens
ggaccctcaggcctgtca

SEQ ID NO: 46583 - DNA, 17 bp, Homo sapiens
agtggctgtggcactga

SEQ ID NO: 46584 - DNA, 16 bp, Homo sapiens
aggcaggattgaaaca

SEQ ID NO: 46585 - DNA, 21 bp, Homo sapiens
gctggcagaatcctggtgtca

SEQ ID NO: 46586 - DNA, 23 bp, Homo sapiens
cctgcatttgctcttctaacaaa

SEQ ID NO: 46587 - DNA, 21 bp, Homo sapiens
gcccttcctcggcatctggag

SEQ ID NO: 46588 - DNA, 23 bp, Homo sapiens
cttgaaagcggattcagaggaca

SEQ ID NO: 46589 - DNA, 17 bp, Homo sapiens
ggggcagctcctcacca

SEQ ID NO: 46590 - DNA, 17 bp, Homo sapiens
tgaaagcggattcagag

SEQ ID NO: 46591 - DNA, 21 bp, Homo sapiens
acctctaagtggctctgggga

SEQ ID NO: 46592 - DNA, 20 bp, Homo sapiens
tcctgatgatggaataatcc

SEQ ID NO: 46593 - DNA, 16 bp, Homo sapiens
ctggcgtgtcggcaga

SEQ ID NO: 46594 - DNA, 18 bp, Homo sapiens
ggctctgcacactcaggt

SEQ ID NO: 46595 - DNA, 19 bp, Homo sapiens
ccataatttcaggctaaag

SEQ ID NO: 46596 - DNA, 20 bp, Homo sapiens
accaaagaccctactgggca

SEQ ID NO: 46597 - DNA, 20 bp, Homo sapiens
cgagggcggccagcgtgtga

SEQ ID NO: 46598 - DNA, 25 bp, Homo sapiens
gggaatgggctatggcagccctggc

SEQ ID NO: 46599 - DNA, 19 bp, Homo sapiens
aagtagccttcatatctca

SEQ ID NO: 46600 - DNA, 19 bp, Homo sapiens
gcgcctgagcccccggggg

SEQ ID NO: 46601 - DNA, 23 bp, Homo sapiens
aggaaaaagagaaatgcttcact

SEQ ID NO: 46602 - DNA, 23 bp, Homo sapiens
ccctgcaacagaaggcctttgaa

SEQ ID NO: 46603 - DNA, 18 bp, Homo sapiens
acacgttcagtgccctca

SEQ ID NO: 46604 - DNA, 21 bp, Homo sapiens
cagacagaaaaagaagaagct

SEQ ID NO: 46605 - DNA, 18 bp, Homo sapiens
ttcccttggaatggtgtt

SEQ ID NO: 46606 - DNA, 20 bp, Homo sapiens
cagctggtgtccaccatcat

SEQ ID NO: 46607 - DNA, 22 bp, Homo sapiens
caggtgatccactccatcctca

SEQ ID NO: 46608 - DNA, 23 bp, Homo sapiens
gcaacgtggtggtccagctttat

SEQ ID NO: 46609 - DNA, 18 bp, Homo sapiens
cagtccgcatatgccaga

SEQ ID NO: 46610 - DNA, 21 bp, Homo sapiens
caggatcttccaggcttggca

SEQ ID NO: 46611 - DNA, 24 bp, Homo sapiens
ctctgacactgctgcaacatgcaa

SEQ ID NO: 46612 - DNA, 19 bp, Homo sapiens
gcgagcagaactgattaca

SEQ ID NO: 46613 - DNA, 21 bp, Homo sapiens
ctcttgcttatcaacattttt

SEQ ID NO: 46614 - DNA, 22 bp, Homo sapiens
aaccaggccggccactcagaga

SEQ ID NO: 46615 - DNA, 24 bp, Homo sapiens
aaccaggctggcaccgcccagagg

SEQ ID NO: 46616 - DNA, 19 bp, Homo sapiens
acctgtccagtgctggcca

SEQ ID NO: 46617 - DNA, 19 bp, Homo sapiens
agactcggggcggtacctg

SEQ ID NO: 46618 - DNA, 20 bp, Homo sapiens
atctccaaagacgacccctt

SEQ ID NO: 46619 - DNA, 21 bp, Homo sapiens
catccagctgctcccaggctg

SEQ ID NO: 46620 - DNA, 18 bp, Homo sapiens
ccaaacacttccagctca

SEQ ID NO: 46621 - DNA, 20 bp, Homo sapiens
cccaagatcacgtggcaccg

SEQ ID NO: 46622 - DNA, 22 bp, Homo sapiens
ccctggtgagcaggcctgggga

SEQ ID NO: 46623 - DNA, 23 bp, Homo sapiens
ccctggtgctaaaaggcctgagg

SEQ ID NO: 46624 - DNA, 20 bp, Homo sapiens
ccgtggcagagagcaacgag

SEQ ID NO: 46625 - DNA, 21 bp, Homo sapiens
ctggagtgccagagccacgcc

SEQ ID NO: 46626 - DNA, 19 bp, Homo sapiens
gagatcgtgtggctgaagg

SEQ ID NO: 46627 - DNA, 17 bp, Homo sapiens
gatgggcagccgccgcc

SEQ ID NO: 46628 - DNA, 20 bp, Homo sapiens
gcactgaaccaggccggcca

SEQ ID NO: 46629 - DNA, 21 bp, Homo sapiens
gcatctacacttgtgctgcta

SEQ ID NO: 46630 - DNA, 19 bp, Homo sapiens
ggctctggccacaccctca

SEQ ID NO: 46631 - DNA, 20 bp, Homo sapiens
tcaggcctcttcgcctgcca

SEQ ID NO: 46632 - DNA, 23 bp, Homo sapiens
tcctggtggctgaaggcttggga

SEQ ID NO: 46633 - DNA, 19 bp, Homo sapiens
tgcccagggcaccccccag

SEQ ID NO: 46634 - DNA, 23 bp, Homo sapiens
tgccctccaacgccctgctcctc

SEQ ID NO: 46635 - DNA, 19 bp, Homo sapiens
tggcccccacacaggtacc

SEQ ID NO: 46636 - DNA, 18 bp, Homo sapiens
ttgtggtcggcctggccc

SEQ ID NO: 46637 - DNA, 19 bp, Homo sapiens
tttggcgtggccacactca

SEQ ID NO: 46638 - DNA, 20 bp, Homo sapiens
cctctttgtcaaccgcatgt

SEQ ID NO: 46639 - DNA, 20 bp, Homo sapiens
ggatggaaccaatctttgag

SEQ ID NO: 46640 - DNA, 16 bp, Homo sapiens
tgggcaggccactttt

SEQ ID NO: 46641 - DNA, 19 bp, Homo sapiens
ggccactttgtagaaatca

SEQ ID NO: 46642 - DNA, 23 bp, Homo sapiens
tcaccaggcaaatacctgttctg

SEQ ID NO: 46643 - DNA, 24 bp, Homo sapiens
tttgggggcccattacacacccca

SEQ ID NO: 46644 - DNA, 18 bp, Homo sapiens
atgctgatttggtgacca

SEQ ID NO: 46645 - DNA, 22 bp, Homo sapiens
tccaaccttcccaaacgcctcc

SEQ ID NO: 46646 - DNA, 23 bp, Homo sapiens
tgggggacccaatgtaggagctg

SEQ ID NO: 46647 - DNA, 24 bp, Homo sapiens
cccttccccaccccaggtgtcctg

SEQ ID NO: 46648 - DNA, 24 bp, Homo sapiens
aataagtatctttgggaaatcttt

SEQ ID NO: 46649 - DNA, 18 bp, Homo sapiens
aatagtggaaatgatgaa

SEQ ID NO: 46650 - DNA, 18 bp, Homo sapiens
accgtacgttgccaaata

SEQ ID NO: 46651 - DNA, 18 bp, Homo sapiens
agtaaccacaaattgcca

SEQ ID NO: 46652 - DNA, 20 bp, Homo sapiens
atgtgaatacagatatcaca

SEQ ID NO: 46653 - DNA, 17 bp, Homo sapiens
gtttttattctcactta

SEQ ID NO: 46654 - DNA, 22 bp, Homo sapiens
tgaaagaagagacaggcaatga

SEQ ID NO: 46655 - DNA, 17 bp, Homo sapiens
agaagaaaagagcacct

SEQ ID NO: 46656 - DNA, 16 bp, Homo sapiens
ccactattacaagcca

SEQ ID NO: 46657 - DNA, 18 bp, Homo sapiens
ccagtgtgatggctgtga

SEQ ID NO: 46658 - DNA, 18 bp, Homo sapiens
cctatcagttgcaaaagc

SEQ ID NO: 46659 - DNA, 17 bp, Homo sapiens
ggacacacctgcccatg

SEQ ID NO: 46660 - DNA, 19 bp, Homo sapiens
ggccccaaaacttccctac

SEQ ID NO: 46661 - DNA, 22 bp, Homo sapiens
taaggtaactgggatttggtta

SEQ ID NO: 46662 - DNA, 21 bp, Homo sapiens
taccagtgtgatggctgtgac

SEQ ID NO: 46663 - DNA, 20 bp, Homo sapiens
agtgacccttctccaccccc

SEQ ID NO: 46664 - DNA, 23 bp, Homo sapiens
cccttctccacccccatatccta

SEQ ID NO: 46665 - DNA, 18 bp, Homo sapiens
tccagggccacgttccag

SEQ ID NO: 46666 - DNA, 23 bp, Homo sapiens
tgcaggaggcccctgtgcaggtg

SEQ ID NO: 46667 - DNA, 23 bp, Homo sapiens
ccacatttctctcttctccctca

SEQ ID NO: 46668 - DNA, 22 bp, Homo sapiens
cctcctttcccctcttccctgg

SEQ ID NO: 46669 - DNA, 25 bp, Homo sapiens
gcctctttccctcctcctctccctc

SEQ ID NO: 46670 - DNA, 19 bp, Homo sapiens
ctccccatccccatctggt

SEQ ID NO: 46671 - DNA, 22 bp, Homo sapiens
cgcgcgcctccttcctcgccgc

SEQ ID NO: 46672 - DNA, 17 bp, Homo sapiens
agaacatagagataggg

SEQ ID NO: 46673 - DNA, 22 bp, Homo sapiens
agaacatgaagaaatgacccca

SEQ ID NO: 46674 - DNA, 17 bp, Homo sapiens
atgagaacaccacacca

SEQ ID NO: 46675 - DNA, 17 bp, Homo sapiens
atgagaacaccacacca

SEQ ID NO: 46676 - DNA, 17 bp, Homo sapiens
atgagaacaccacacca

SEQ ID NO: 46677 - DNA, 17 bp, Homo sapiens
atgagaacaccacacca

SEQ ID NO: 46678 - DNA, 17 bp, Homo sapiens
atgagaacaccacacca

SEQ ID NO: 46679 - DNA, 17 bp, Homo sapiens
atgagaacaccacatca

SEQ ID NO: 46680 - DNA, 19 bp, Homo sapiens
caccacaccatccccagca

SEQ ID NO: 46681 - DNA, 20 bp, Homo sapiens
ccatgagggggaggctgcca

SEQ ID NO: 46682 - DNA, 20 bp, Homo sapiens
gaagaaaactccagcaacca

SEQ ID NO: 46683 - DNA, 19 bp, Homo sapiens
gtatcaagaaggcctgcca

SEQ ID NO: 46684 - DNA, 21 bp, Homo sapiens
tctggttgaaccacgtggcca

SEQ ID NO: 46685 - DNA, 21 bp, Homo sapiens
tgtgttggcttaatttctgga

SEQ ID NO: 46686 - DNA, 19 bp, Homo sapiens
ccaggttccttcttgcaca

SEQ ID NO: 46687 - DNA, 19 bp, Homo sapiens
ctgctggtttcccgaggga

SEQ ID NO: 46688 - DNA, 17 bp, Homo sapiens
ggccccctgaaatctca

SEQ ID NO: 46689 - DNA, 26 bp, Homo sapiens
tctgtccaggtgcccctcatcatcac

SEQ ID NO: 46690 - DNA, 22 bp, Homo sapiens
agacactggaaagagaatacta

SEQ ID NO: 46691 - DNA, 15 bp, Homo sapiens
aggagacccctccca

SEQ ID NO: 46692 - DNA, 21 bp, Homo sapiens
agttgcacatgttttccccta

SEQ ID NO: 46693 - DNA, 20 bp, Homo sapiens
ggcctcactctgttgcacaa

SEQ ID NO: 46694 - DNA, 17 bp, Homo sapiens
tcaaaatctccacagta

SEQ ID NO: 46695 - DNA, 18 bp, Homo sapiens
atgctgatttggtgacca

SEQ ID NO: 46696 - DNA, 22 bp, Homo sapiens
tccaaccttcccaaacgcctcc

SEQ ID NO: 46697 - DNA, 23 bp, Homo sapiens
tgggggacccaatgtaggagctg

SEQ ID NO: 46698 - DNA, 21 bp, Homo sapiens
cagggtgcgctggtcccggtc

SEQ ID NO: 46699 - DNA, 16 bp, Homo sapiens
tgggcaggccactttt

SEQ ID NO: 46700 - DNA, 19 bp, Homo sapiens
ctccccatccccatctggt

SEQ ID NO: 46701 - DNA, 20 bp, Homo sapiens
agtgacccttctccaccccc

SEQ ID NO: 46702 - DNA, 23 bp, Homo sapiens
cccttctccacccccatatccta

SEQ ID NO: 46703 - DNA, 18 bp, Homo sapiens
tccagggccacgttccag

SEQ ID NO: 46704 - DNA, 23 bp, Homo sapiens
tgcaggaggcccctgtgcaggtg

SEQ ID NO: 46705 - DNA, 16 bp, Homo sapiens
ccactattacaagcca

SEQ ID NO: 46706 - DNA, 18 bp, Homo sapiens
ccagtgtgatggctgtga

SEQ ID NO: 46707 - DNA, 18 bp, Homo sapiens
cctatcagttgcaaaagc

SEQ ID NO: 46708 - DNA, 17 bp, Homo sapiens
ggacacacctgcccatg

SEQ ID NO: 46709 - DNA, 19 bp, Homo sapiens
ggccccaaaacttccctac

SEQ ID NO: 46710 - DNA, 22 bp, Homo sapiens
taaggtaactgggatttggtta

SEQ ID NO: 46711 - DNA, 21 bp, Homo sapiens
taccagtgtgatggctgtgac

SEQ ID NO: 46712 - DNA, 23 bp, Homo sapiens
ccacatttctctcttctccctca

SEQ ID NO: 46713 - DNA, 22 bp, Homo sapiens
cctcctttcccctcttccctgg

SEQ ID NO: 46714 - DNA, 25 bp, Homo sapiens
gcctctttccctcctcctctccctc

SEQ ID NO: 46715 - DNA, 17 bp, Homo sapiens
agaagaaaagagcacct

SEQ ID NO: 46716 - DNA, 22 bp, Homo sapiens
cgcgcgcctccttcctcgccgc

SEQ ID NO: 46717 - DNA, 24 bp, Homo sapiens
aataagtatctttgggaaatcttt

SEQ ID NO: 46718 - DNA, 18 bp, Homo sapiens
aatagtggaaatgatgaa

SEQ ID NO: 46719 - DNA, 18 bp, Homo sapiens
accgtacgttgccaaata

SEQ ID NO: 46720 - DNA, 18 bp, Homo sapiens
agtaaccacaaattgcca

SEQ ID NO: 46721 - DNA, 20 bp, Homo sapiens
atgtgaatacagatatcaca

SEQ ID NO: 46722 - DNA, 17 bp, Homo sapiens
gtttttattctcactta

SEQ ID NO: 46723 - DNA, 22 bp, Homo sapiens
tgaaagaagagacaggcaatga

SEQ ID NO: 46724 - DNA, 18 bp, Homo sapiens
catatcccttttctcctc

SEQ ID NO: 46725 - DNA, 19 bp, Homo sapiens
ctaattcctcagtaacctc

SEQ ID NO: 46726 - DNA, 20 bp, Homo sapiens
gaagcaacaaattcccttta

SEQ ID NO: 46727 - DNA, 23 bp, Homo sapiens
tccagtaacacagaagcaaccaa

SEQ ID NO: 46728 - DNA, 17 bp, Homo sapiens
agaacatagagataggg

SEQ ID NO: 46729 - DNA, 22 bp, Homo sapiens
agaacatgaagaaatgacccca

SEQ ID NO: 46730 - DNA, 17 bp, Homo sapiens
atgagaacaccacacca

SEQ ID NO: 46731 - DNA, 17 bp, Homo sapiens
atgagaacaccacacca

SEQ ID NO: 46732 - DNA, 17 bp, Homo sapiens
atgagaacaccacacca

SEQ ID NO: 46733 - DNA, 17 bp, Homo sapiens
atgagaacaccacacca

SEQ ID NO: 46734 - DNA, 17 bp, Homo sapiens
atgagaacaccacacca

SEQ ID NO: 46735 - DNA, 17 bp, Homo sapiens
atgagaacaccacatca

SEQ ID NO: 46736 - DNA, 19 bp, Homo sapiens
caccacaccatccccagca

SEQ ID NO: 46737 - DNA, 20 bp, Homo sapiens
ccatgagggggaggctgcca

SEQ ID NO: 46738 - DNA, 20 bp, Homo sapiens
gaagaaaactccagcaacca

SEQ ID NO: 46739 - DNA, 19 bp, Homo sapiens
gtatcaagaaggcctgcca

SEQ ID NO: 46740 - DNA, 22 bp, Homo sapiens
ccggaacccccttcctgttcct

SEQ ID NO: 46741 - DNA, 18 bp, Homo sapiens
gatccttcctggactcca

SEQ ID NO: 46742 - DNA, 18 bp, Homo sapiens
gatggcacagggctgtgg

SEQ ID NO: 46743 - DNA, 23 bp, Homo sapiens
tgaggttcctgggcccgcaccac

SEQ ID NO: 46744 - DNA, 21 bp, Homo sapiens
tggtgtttggcgctggaatta

SEQ ID NO: 46745 - DNA, 21 bp, Homo sapiens
tctggttgaaccacgtggcca

SEQ ID NO: 46746 - DNA, 21 bp, Homo sapiens
tgtgttggcttaatttctgga

SEQ ID NO: 46747 - DNA, 22 bp, Homo sapiens
agacactggaaagagaatacta

SEQ ID NO: 46748 - DNA, 15 bp, Homo sapiens
aggagacccctccca

SEQ ID NO: 46749 - DNA, 21 bp, Homo sapiens
agttgcacatgttttccccta

SEQ ID NO: 46750 - DNA, 20 bp, Homo sapiens
ggcctcactctgttgcacaa

SEQ ID NO: 46751 - DNA, 17 bp, Homo sapiens
tcaaaatctccacagta

SEQ ID NO: 46752 - DNA, 19 bp, Homo sapiens
aaaccttaaaatttggtga

SEQ ID NO: 46753 - DNA, 22 bp, Homo sapiens
cttggctccagctggtccctcc

SEQ ID NO: 46754 - DNA, 21 bp, Homo sapiens
gtgataaatatccatgaaatc

SEQ ID NO: 46755 - DNA, 21 bp, Homo sapiens
tgggtggatcacctgaggtta

SEQ ID NO: 46756 - DNA, 705 bp, Homo Sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 46757 - DNA, 1262 bp, Homo Sapiens
gcaaaaactggaagcattccctttgaaaactggcacaagacagggatgccctctctcaccgctcctattcaacatagtgttggaagttctggccagggcaattaggcaggagaaggaaataaagggtattcaattaggaaaagagcaagtcaaattgttcctgtttgcagatgacatgattgtatatctagaaaaccccattgtctcagccccaaatctccttaagctgataagcaacttcagcaaagtctcaggatacaaaataaatgtacaaaaatcacaagcattcttacacaccaacaacagaaaaacagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactttactacaaggctacagtaaccaaaacagcatggtactggtaccaaaacagagatatagatcaatggaacagaacagagccctcagaaataacgccgaatacctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaaaaaaaaaaaaaaa

SEQ ID NO: 46758 - DNA, 1445 bp, Homo Sapiens
actcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccatttgtcaattttggcttttgttgcaattgcttttggcatcttcgtcatgaaatctttgcccttgcctgtgtcctgaatggcattgcctaggttttcttccaggatttttatagttttgggttgtagatttaagtctttaatccatcttgagttaacttttgtatatgggttaaggaaggggcccgtttcaatttgctgcaaatggctagccagttctcccagcaccatttattaaatagggaatcttttccccattgcttccttttgtcaggtttgtcaaagatcacatggttgtaggtgtgtggtcttatttctgggttctctattctgttccattgggctatgggccggttctgtaccaccactatgctgttttgggtaccatagtcttgtagaatgtttgaagctgggtagcatgatgcctctagctttgctcttcttgctaagaaatgtcttggctatttgggctcttttttggttccatatgaattttaaaatagctttttctaggtctgtaaagaatgtgaatagtagtttaatgggcctagcatttaatttacagattgccttgggcagtgtggtcattttcacgatattgatccttcctgtctgtgagcatatgtttttccatttgtttgtgtcatctctgatttctttgaataatggtttatagttatccttgaaaaggtccttcacttttcttgttagctgtattcctagatattatactcttcttgtggcaattgtgaatgggagttaattcatgagttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaacaaagatagtttgacttcctgtcttcctatttgaatagcttttctttctttctcttgcctgattgccttggtgagaatttctaatactgtgttgaataggagtggtgagctcgtgccaa

SEQ ID NO: 46759 - DNA, 42 bp, Homo Sapiens
taatacgactcactatagggtgaggtagtaagttgtattgtt

SEQ ID NO: 46760 - DNA, 41 bp, Homo Sapiens
aattaaccctcactaaagggaaagtagtaagttgtatagtt

SEQ ID NO: 46761 - DNA, 40 bp, Homo Sapiens
taatacgactcactataggcccttattagaggattctgct

SEQ ID NO: 46762 - DNA, 41 bp, Homo Sapiens
aattaaccctcactaaaggtttttttttcctgagacagagt

SEQ ID NO: 46763 - DNA, 20 bp, Homo Sapiens
gaggcaggagaattgcttga

SEQ ID NO: 46764 - DNA, 39 bp, Homo Sapiens
aattaaccctcactaaaggcctgagacagagtcttgctc
